(12) United States Patent
Cushman et al.

(10) Patent No.: US 10,858,404 B2
(45) Date of Patent: Dec. 8, 2020

(54) ENGINEERING CRASSULACEAN ACID METABOLISM (CAM) PATHWAYS IN PLANTS

(71) Applicant: BOARD OF REGENTS OF NEVADA SYSTEM OF HIGHER EDUCATION, ON BEHALF OF UNIVERSITY, Reno, NV (US)

(72) Inventors: John C. Cushman, Reno, NV (US); Sung Don Lim, Reno, NV (US); Won Cheol Yim, Reno, NV (US)

(73) Assignee: BOARD OF REGENTS OF THE NEVADA SYSTEM OF HIGHER EDUCATION ON BEHALF OF THE UNIVERSITY OF NEVADA, RENO, Reno, NV (US)

( * ) Notice: Subject to any disclaimer, the term of this patent is extended or adjusted under 35 U.S.C. 154(b) by 90 days.

(21) Appl. No.: 16/027,145

(22) Filed: Jul. 3, 2018

(65) Prior Publication Data
US 2019/0093122 A1  Mar. 28, 2019

Related U.S. Application Data

(63) Continuation-in-part of application No. PCT/US2017/012639, filed on Jan. 6, 2017.

(60) Provisional application No. 62/276,438, filed on Jan. 8, 2016.

(51) Int. Cl.
*A01H 1/00* (2006.01)
*A01H 5/00* (2018.01)
*C07K 14/415* (2006.01)

(52) U.S. Cl.
CPC ............. *C07K 14/415* (2013.01); *A01H 1/00* (2013.01); *A01H 5/00* (2013.01)

(58) Field of Classification Search
None
See application file for complete search history.

(56) References Cited

U.S. PATENT DOCUMENTS

2014/0150135 A1* 5/2014 Grunden ............ C12N 15/8218
800/290

OTHER PUBLICATIONS

Borland, et al., Engineering crassulacean acid metabolism to improve water-use efficiency, Cell Press Special Issue: Systems Biology, Trends in Plant Science, vol. 19, No. 5, May 2014, pp. 327-338.
Brilhaus, et al., Reversible Burst of Transcriptional Changes during Induction of Crassulacean Acid Metabolism in Talinum triangulare, Plant Physiology, vol. 170, Jan. 2016, pp. 102-122.
Kebeish, et al., Constitutive and Dark-Induced Expression of Solanum tuberosum Phosphoenolpyruvate Carboxylase Enhances Stomatal Opening and Photosynthetic Performance of Arabidopsis thaliana, Biotechnology and Bioengineering, vol. 109, No. 2, Feb. 2012, pp. 536-544.
Koo, et al., A GUS/Luciferase Fusion Reporter for Plant Gene Trapping and for Assay of Promoter Activity with Luciferin-Dependent Control of the Reporter Protein Stability, Plant Cell Physiol. 48(8), 2007, pp. 1121-1131.
Lara, et al., Induction of a Crassulacean Acid-like Metabolism in the C4 Succulent Plant, *Portulaca oleracea* L.: Study of Enzymes Involved in Carbon Fixation and Carbohydrate Metabolism, Plant Cell Physiol. 45(5), 2004, pp. 618-626.

* cited by examiner

*Primary Examiner* — Phuong T Bui
(74) *Attorney, Agent, or Firm* — Schwabe, Williamson & Wyatt, P.C.

(57) ABSTRACT

Disclosed herein are method of altering CAM pathways in plants. In some examples, a disclosed method includes overexpressing one or more genes encoding one or more enzymes that carry out the basic biochemical sequence of nocturnal $CO_2$ fixation (carboxylation) into $C_4$ acids (malate), store $C_4$ acids in the vacuole of the plant, and/or then decarboxylate and refix the released $CO_2$ by $C_3$ photosynthesis during the subsequent day in a plant cell, thereby altering CAM in the plant cell. Also disclosed herein are isolated polynucleotide sequences, transformation vectors, transgenic plant cells, plant part, and plants. The disclosed methods and compositions can be used to improve the water-use efficiency and drought tolerance and durability of plants, such as in plants in arid environments, and also enhance the ability of plants to perform.

7 Claims, 32 Drawing Sheets

Specification includes a Sequence Listing.

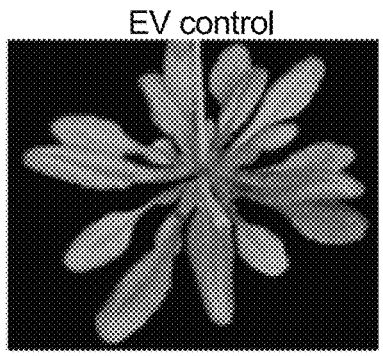
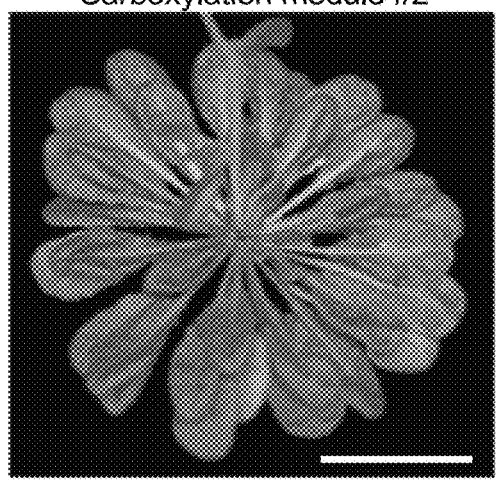
FIG. 27A
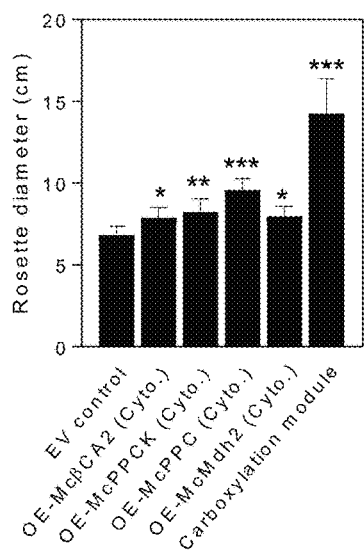
FIG. 27B
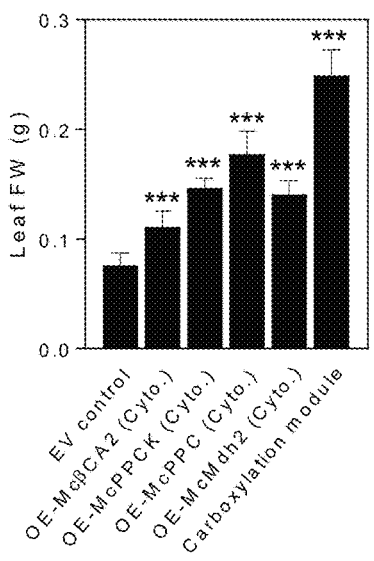
FIG. 27C
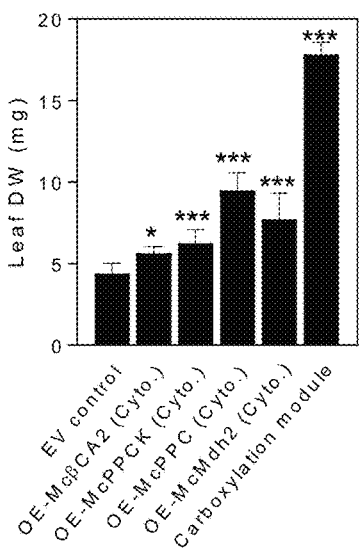
FIG. 27D
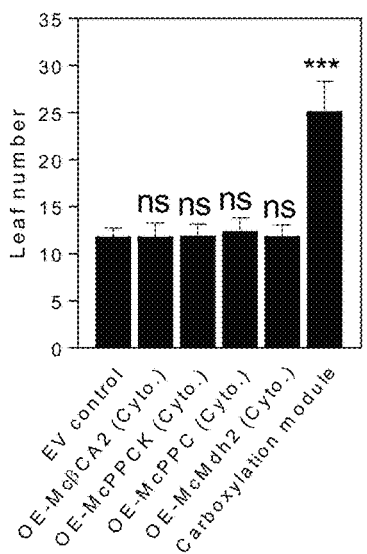
FIG. 27E
FIGS. 27A-27E

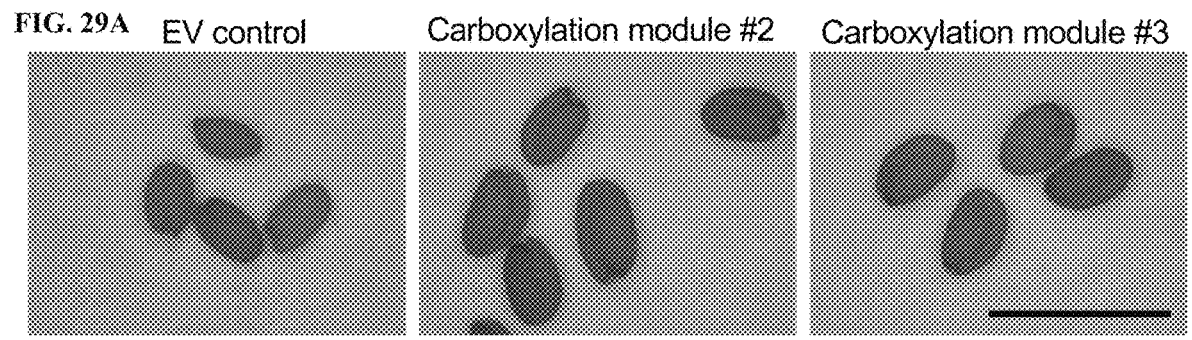
FIG. 29A
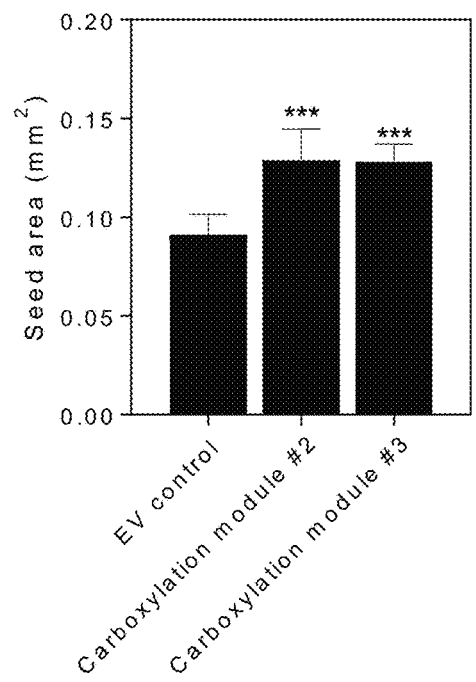
FIG. 29B
FIGS. 29A and 29B

FIG. 30A
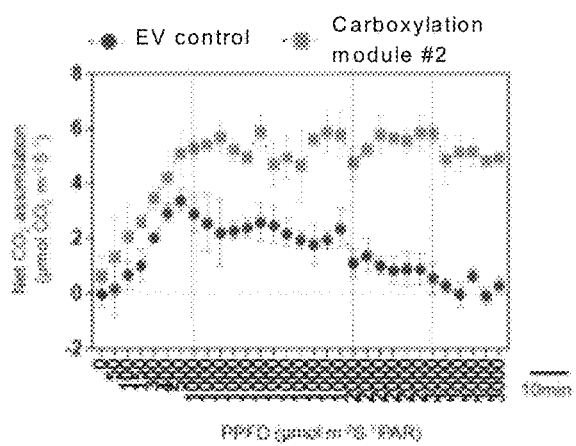
FIG. 30B
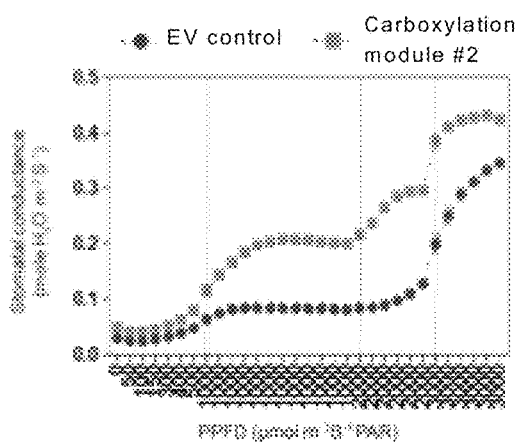
FIG. 30C
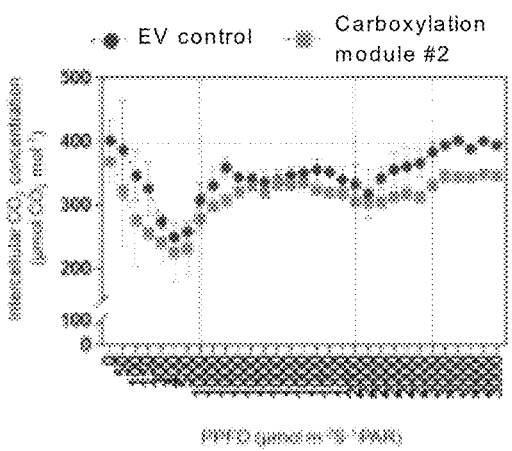
FIG. 30D
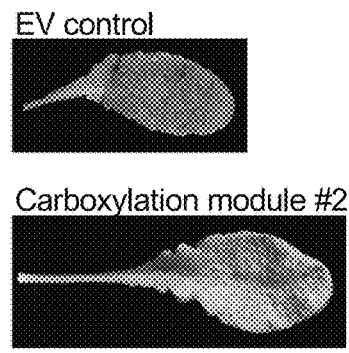
FIGS. 30A-30D

ENGINEERING CRASSULACEAN ACID METABOLISM (CAM) PATHWAYS IN PLANTS

CROSS REFERENCE TO RELATED APPLICATIONS

This application is a Continuation-in-Part of International Application No. PCT/2017/012639, filed Jan. 6, 2017, which was published in English under PCT Article 21(2), which in turn claims the benefit of U.S. Provisional Patent Application No. 62/276,438, filed on Jan. 8, 2016, each disclosure of which is herein incorporated by reference in its entirety.

ACKNOWLEDGMENT OF GOVERNMENT SUPPORT

This invention was made with government support under DE-SC0008834 awarded by the United States Department of Energy. The government has certain rights in the invention.

FIELD

This disclosure relates to the field of plant molecular biology and genetic engineering and specifically to methods of modulating crassulacean acid metabolism (CAM) pathways in plants.

BACKGROUND

There is a pressing need to increase global food production world-wide and to improve plant water-use efficiency and drought tolerance. Global climate change is predicted to increase heat, drought, and soil-drying conditions, and thereby increase crop sensitivity to water vapor pressure deficit, resulting in productivity losses. Increasing competition between agricultural freshwater use and municipal or industrial uses suggest that crops with greater heat and drought durability and greater water-use efficiency will be crucial for sustainable biomass production systems in the future. Thus, there is an on-going need to identify genetic mechanisms and factors involved in improving water-use efficiency, drought tolerance, and overall plant health.

SUMMARY

Disclosed herein are methods of altering crassulacean acid metabolism (CAM) pathways in plants. Also disclosed herein are isolated polynucleotide sequences comprising a plant promoter, a polynucleotide sequence of a gene encoding one or more enzymes involved in regulating CAM pathways, polynucleotide sequence of a plant terminator, and a polynucleotide sequence of an insulator to improve expression in a plant. Plant transformation vectors comprising a disclosed isolated polynucleotide sequence are also provided to facilitate the construction of multi-gene circuits for expression within plant cells. Moreover, transgenic plant cells, plant part, and plants comprising a disclosed vector construct are provided.

In some embodiments a disclosed method comprises overexpressing one or more genes encoding one or more enzymes that carry out the basic biochemical sequence of nocturnal $CO_2$ fixation (carboxylation) into $C_4$ acids (malate), store $C_4$ acids in the vacuole of the plant, and/or then decarboxylate and refix the released $CO_2$ by $C_3$ photosynthesis during the subsequent day in a plant cell, thereby altering CAM in the plant cell. In one embodiment, the one or more genes comprise McBca2 (Beta carbonic anhydrase 2), McPpck (phosphoenolpyruvate carboxylase kinase), McPpc1 (phosphoenolpyruvate carboxylase), McNAD-Mdh2 [NAD(P) malate dehydrogenase 2], McALMT4 (putative aluminum-activated malate transporter), MctDT (tonoplast dicarboxylate transporter), McNADP-ME3 (NADP-dependent malic enzyme 3), McPpdk1 (pyruvate orthophosphate dikinase), and/or McPpdk-RP (pyruvate orthophosphate dikinase-regulatory protein). In some examples, the sequence includes full-length wild-type (or native) coding sequence, as well as allelic variants, fragments, homologs or fusion sequences that retain the ability to be expressed at increased levels in a plant cell and regulate the temporal or circadian expression of CAM, and trigger increased CAM expression under water-deficit stress conditions. In certain examples, the sequence has at least 80% sequence identity, for example at least 85%, 90%, 95%, or 98% sequence identity to wild-type sequence for McBca2 (Beta carbonic anhydrase 2), McPpck (phosphoenolpyruvate carboxylase kinase), McPpc1 (phosphoenolpyruvate carboxylase), McNAD-Mdh2 [NAD(P) malate dehydrogenase 2], McALMT4 (putative aluminum-activated malate transporter), MctDT (tonoplast dicarboxylate transporter), McNADP-ME3 (NADP-dependent malic enzyme 3), McPpdk1 (pyruvate orthophosphate dikinase), and/or McPpdk-RP (pyruvate orthophosphate dikinase-regulatory protein).

The disclosed methods can be used to improve the water-use efficiency and drought tolerance or durability of plants, such as in plants in arid environments, and also enhance the ability of plants to perform. In some examples, a disclosed method is used to increase plant cell size, leaf size, leaf number, reduce hypocotyl length, increase hypocotyl length, increase inflorescence width, increase inflorescence height, increase plant root size, increase plant root length, increase plant tissue succulence, increase plant water content, increase plant flower size, increase plant floral organ size, increase plant silique, increase fruit size, increase plant seed size, increase plant seed area, increase plant mass, increase plant seed number, increase plant total seed production; increase plant inflorescence number, or any combination thereof. In some examples, the method is used to generate a plant with improved water-use efficiency or drought tolerance. In some examples, the method is used to delay plant flowering time, such as up to two weeks. In other examples, the method is used to stimulate plant flowering. In some examples, the method is used to reduce intracellular air space with the resulting plant becoming an anatomically optimized host for performance of (engineered) CAM. In some examples, the method is used to increase plant tolerance to salinity and related salts that impose an ionic stress. In some examples, the methods are used to increase plant tolerance to osmotic stress, such as to mannitol or PEG, and related osmotic agents that impose an osmotic stress.

In some embodiments, a disclosed method for engineered CAM is combined with engineered tissue succulence (such as that disclosed in U.S. Patent Provisional Application No. 62/255,158, filed on Nov. 13, 2015 and PCT/US2016/06177, filed on Nov. 13, 2016, each of which is hereby incorporated by reference in its entirety) in order to improve the overall operational efficiency of the CAM pathway by limited the diffusion of $CO_2$ from leaf tissues during the daytime decarboxylation phases of the CAM cycle.

The foregoing and other features and advantages of the invention will become more apparent from the following detailed description, which proceeds with reference to the accompanying figures.

BRIEF DESCRIPTION OF THE DRAWINGS

FIGS. 27A-27E illustrates engineered carboxylation module synergistically increase overall plant biomass.

FIGS. 29A and 29B illustrate engineered carboxylation module increase seed size in *Arabidopsis*.

FIGS. 30A-30D illustrate engineered carboxylation module increases net $CO_2$ assimilation, stomatal conductance, and ROS scavenging capacity under highlight conditions in *Arabidopsis*.

SEQUENCE LISTING

The nucleic and amino acid sequences listed in the accompanying sequence listing are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand. The Sequence Listing is submitted as an ASCII text file in the form of the file named "Sequence.txt", which is incorporated by reference herein.

DETAILED DESCRIPTION

I. Introduction

CAM is a specialized form of photosynthesis that reduces relative crop water demand about five-to-six-fold compared with $C_3$ photosynthesis species. This water saving adaptation shifts atmospheric $CO_2$ uptake from the day, when transpirational water losses are high, to the night when such losses are greatly reduced, which in turn results in greater water-use efficiency and improved drought tolerance.

Figure 1:
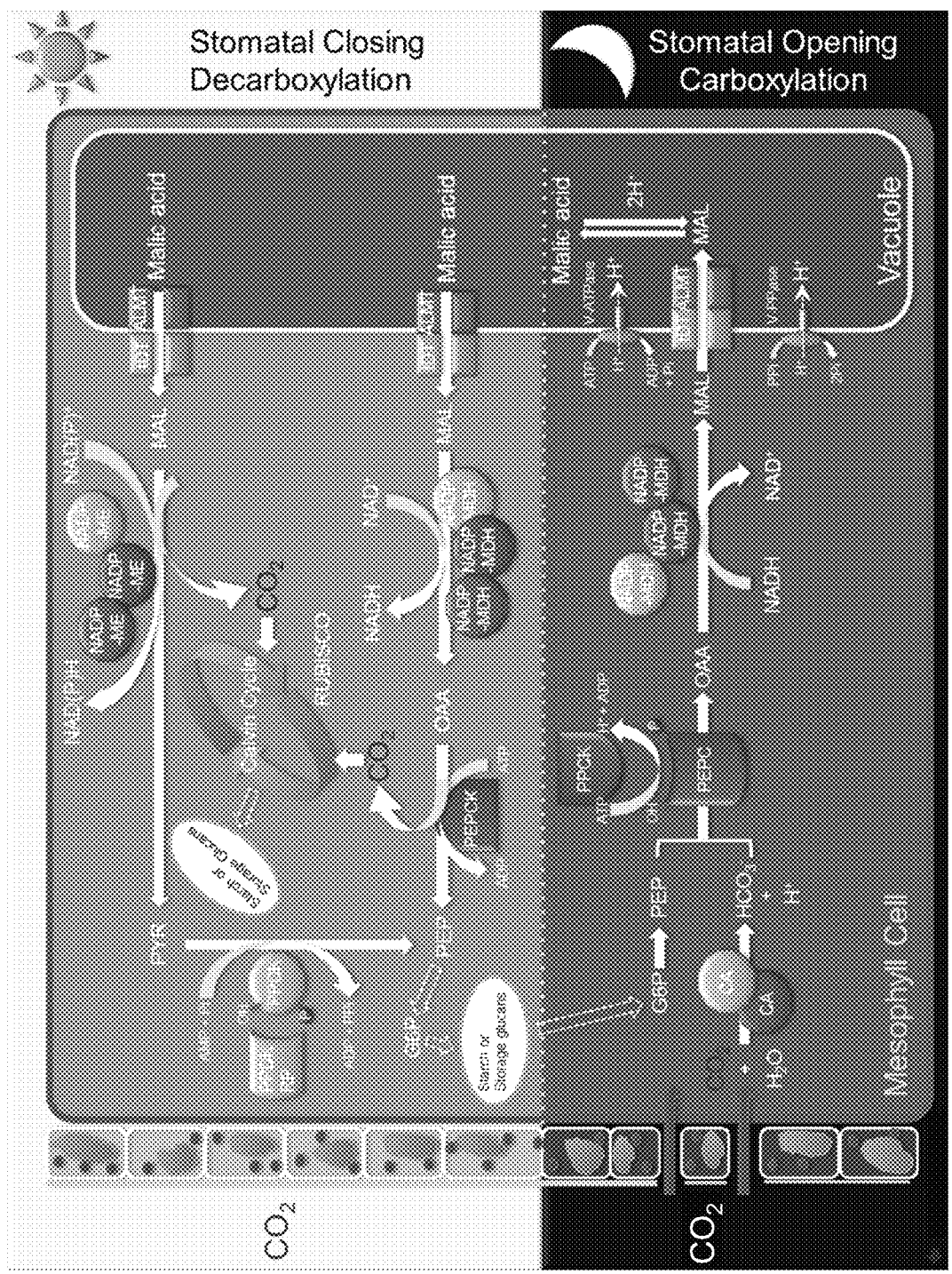
FIG. 1 is diagram of the Crassulacean acid metabolism (CAM) photosynthetic pathway.

FIG. 1 provides a simplified diagram of the CAM photosynthetic pathway. CAM plants open their stomata during the night, allowing atmospheric $CO_2$ to enter and is converted to bicarbonate ($HCO_3$—) by carbonic anhydrase (CA). Next, the primary carboxylation step combines the $HCO_3$— with phosphoenolpyruvate (PEP) as catalyzed by phosphoenolpyruvate carboxylase (PEPC) leading to the formation of oxaloacetate (OAA), which is converted into malate (MAL) a $C_4$ acid by malate dehydrogenase, which is then transported into the vacuole by malate transporters (tDT and ALMT) where it undergoes protonation and storage as malic acid. During the subsequent day, when stomata are closed, malic acid exits the vacuole and is decarboxylated to release $CO_2$ in the chloroplast and is refixed via a secondary carboxylation step by ribulose-1,5-bisphosphate carboxylase/oxygenase (RUBISCO) through the Calvin cycle. $C_3$ acids serve as the substrate for gluconeogenesis where carbohydrates are regenerated and stored as starch (or other storage polysaccharides depending on the plant species). During the subsequent night, starch is degraded to form PEP, thus completing the temporal cycle. Key metabolites and transporters (core CAM genes): glucose-6-phosphate (G6P), phosphoenolpyruvate (PEP), carbonic anhydrase (CA), PEP carboxylase (PPC), PPC kinase (PPCK), NAD(P) malate dehydrogenase (NAD(P)-MDH), NADP-dependent malic enzyme (NADP-ME), pyruvate orthophosphate dikinase (PPDK), PPDK regulatory protein (PPDK-RP), PEP carboxykinase (PEPCK), tonoplast dicarboxylate transporter (tDT), aluminum-activated malate transporter (ALMT), vacuolar ATPase (V-ATPase), and vacuolar pyrophosphatase (V-PPiase).

Disclosed herein are methods for the genetic engineering of CAM. In an exemplary embodiment, the method includes overexpression of a set of genes are encoding a suite of enzymes that carry out the basic biochemical sequence of nocturnal $CO_2$ fixation (carboxylation) into $C_4$ acids (malate), store these $C_4$ acids in the vacuole of the plant, and then decarboxylate and refix the released $CO_2$ by $C_3$ photosynthesis during the subsequent day. For example, the method allows these enzymes to be expressed at the appropriate time of day using a matched set of time-specific 5' regulatory regions identified in the target host plant (e.g., Arabidopsis thaliana). Another advantage of disclosed methods is the expression of these genes encoding this suite of CAM enzymes will only occur in a significant way when the plants are exposed to water-deficit stress. The disclosed methods avoid the energetic burden of performing CAM, estimated to be about 10% of a plant's energy budget, unless this water-saving adaptation is needed and thus preserve high plant growth rates under well-watered conditions.

In particular, a suite of 9 (or more) genes encoding enzymes that carry out a sequence of enzymatic reactions required for the nocturnal carboxylation of $CO_2$ to malic acid and the subsequent daytime decarboxylation of malate to release $CO_2$ within the chloroplast for $C_3$ photosynthesis were characterized from the facultative CAM species Mesembryanthemum crystallinum. Each gene product was then tested to determine its exact subcellular localization to validate the expected location within the cell. Each gene was then expressed under the control of a circadianly controlled 5' regulatory region (i.e., promoter) from Arabidopsis thaliana that conferred the correct temporal expression pattern necessary to carry out the proper biochemical sequence of enzymatic reactions and transport steps. Each promoter conferred increased expression of their respective transgene under conditions of water-deficit stress so that the CAM pathway was operational largely under water-deficit conditions. This conditional or facultative induction of the engineered CAM pathway retained robust plant growth and overall productivity under well-watered conditions. Gypsy barrier insulators, which prevent transcriptional interference from adjacent transcriptional cassettes and gene silencing, were included into each expression cassette to prevent or decrease transgene silencing. Each enzyme or transporter was also tagged with a unique epitope tag to monitor transgene expression within the plant. Each expression cassette was then combined into a series of complex gene circuits using the Gibson assembly approach. Thus, the disclosed methods permit plants to shift their atmospheric $CO_2$ uptake from the day, when transpirational water losses are high, to the night when such losses are greatly reduced, which in turn results in greater water-use efficiency, while also conferring improved drought tolerance. The disclosed methods and compositions benefit the agribusiness sector by reducing water inputs needed for crops, while at the same time improving drought tolerance. Moreover, they confer value to the agribusiness sector through increased water-use efficiency and reductions in crop water demand, while also conferring improved drought tolerance.

II. Terms

The following explanations of terms and methods are provided to better describe the present disclosure and to guide those of ordinary skill in the art in the practice of the present disclosure. As used herein, "comprising" means "including" and the singular forms "a" or "an" or "the" include plural references unless the context clearly dictates otherwise. For example, reference to "comprising a plant" includes one or a plurality of such plants and reference to "the seed" includes reference to one or more seeds and equivalents thereof known to those skilled in the art, and so forth. The term "or" refers to a single element of stated alternative elements or a combination of two or more elements, unless the context clearly indicates otherwise. For example, the phrase "A or B" refers to A, B, or a combination of both A and B.

Furthermore, the various elements, features and steps discussed herein, as well as other known equivalents for each such element, feature or step, can be mixed and matched by one of ordinary skill in this art to perform methods in accordance with principles described herein. Among the various elements, features, and steps some will be specifically included and others specifically excluded in particular examples.

Unless explained otherwise, all technical and scientific terms used herein have the same meaning as commonly understood to one of ordinary skill in the art to which this disclosure belongs. Although methods and materials similar or equivalent to those described herein can be used in the practice or testing of the present disclosure, suitable methods and materials are described below. The materials, methods, and examples are illustrative only and not intended to be limiting. All references cited herein are incorporated by reference. Definitions of common terms in molecular biology may be found in Benjamin Lewin *Genes V* published by Oxford University Press, 1994 (ISBN 0-19-854287-9); Kendrew et al. (eds.) *The Encyclopedia of Molecular Biology*, published by Blackwell Science Ltd., 1994 (ISBN 0-632-02182-9); and Robert A. Meyers (ed.) *Molecular Biology and Biotechnology: a Comprehensive Desk Reference*, published by VCH Publishers, Inc., 1995 (ISBN 1-56081-569-8).

Suitable methods and materials for the practice of the disclosed embodiments are described below. In addition, any appropriate method or technique well known to the ordinarily skilled artisan can be used in the performance of the disclosed embodiments. Some conventional methods and techniques applicable to the present disclosure are described, for example, in Sambrook et al., *Molecular Cloning: A Laboratory Manual,* 2d ed., Cold Spring Harbor Laboratory Press, 1989; Sambrook et al., *Molecular Cloning: A Laboratory Manual,* 3d ed., Cold Spring Harbor Press, 2001; Ausubel et al., *Current Protocols in Molecular Biology*, Greene Publishing Associates, 1992 (and Supplements to 2000); Ausubel et al., *Short Protocols in Molecular Biology: A Compendium of Methods from Current Protocols* in *Molecular Biology*, 4th ed., Wiley & Sons, 1999; Harlow and Lane, *Antibodies: A Laboratory Manual*, Cold Spring Harbor Laboratory Press, 1990; Harlow and Lane, *Using Antibodies: A Laboratory Manual*, Cold Spring Harbor Laboratory Press, 1999; and Kieser, T., Bibb, M. J., Buttner, M. J., Chater, K. F., and Hopwood, D. A.: Practical *Streptomyces* genetics, John Innes Centre, Norwich Research Park, Colney, Norwich NR4 &UH, England, 2000.

All publications, patent applications, patents, and other references mentioned herein are incorporated by reference in their entirety. In case of conflict, the present specification, including explanations of terms, will control. In addition, the materials, methods, and examples are illustrative only and not intended to be limiting.

In order to facilitate review of the various embodiments of this disclosure, the following explanations of specific terms are provided:

5' and/or 3': Nucleic acid molecules (such as, DNA and RNA) are said to have "5' ends" and "3' ends" because mononucleotides are reacted to make polynucleotides in a manner such that the 5' phosphate of one mononucleotide pentose ring is attached to the 3' oxygen of its neighbor in one direction via a phosphodiester linkage. Therefore, one end of a polynucleotide is referred to as the "5' end" when its 5' phosphate is not linked to the 3' oxygen of a mononucleotide pentose ring. The other end of a polynucleotide is referred to as the "3' end" when its 3' oxygen is not linked to a 5' phosphate of another mononucleotide pentose ring. Notwithstanding that a 5' phosphate of one mononucleotide pentose ring is attached to the 3' oxygen of its neighbor, an internal nucleic acid sequence also may be said to have 5' and 3' ends.

In either a linear or circular nucleic acid molecule, discrete internal elements are referred to as being "upstream" or 5' of the "downstream" or 3' elements. With regard to DNA, this terminology reflects that transcription proceeds in a 5' to 3' direction along a DNA strand. Promoter and enhancer elements, which direct transcription of a linked gene, are generally located 5' or upstream of the coding region. However, enhancer elements can exert their effect even when located 3' of the promoter element and the coding region. Transcription termination and polyadenylation signals are located 3' or downstream of the coding region.

Agronomic trait: Characteristic of a plant, which characteristics include, but are not limited to, plant morphology, physiology, growth and development, yield, nutritional enhancement, disease or pest resistance, or environmental or chemical tolerance are agronomic traits. An "enhanced agronomic trait" refers to a measurable improvement in an agronomic trait including, but not limited to, yield increase, including increased yield under non-stress conditions and increased yield under environmental stress conditions. Stress conditions may include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density. "Yield" can be affected by many properties including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Yield can also be affected by efficiency of germination (including germination in stressed conditions), growth rate (including growth rate in stressed conditions), siliquie or ear number, seed number per silique or ear, seed size, composition of seed (starch, oil, protein) and characteristics of seed fill. Increased yield may result from improved utilization of key biochemical compounds, such as nitrogen, phosphorous and carbohydrate, or from improved responses to environmental stresses, such as cold, heat, drought, salt, and attack by pests or pathogens. Recombinant DNA used in this disclosure can also be used to provide plants having improved growth and development, and ultimately increased yield, as the result of modified expression of plant growth regulators or modification of cell cycle or photosynthesis pathways. Additional examples of agronomic traits, and altering such traits in plants, are provided herein and/or will be recognized by those of ordinary skill in the art.

Alterations: Alterations in a polynucleotide (for example, a polypeptide encoded by a nucleic acid of the present invention), as this term is used herein, comprise any deletions, insertions, and point mutations in the polynucleotide sequence. Included within this definition are alterations to the genomic DNA sequence that encodes the polypeptide. Likewise, the term "alteration" may be used to refer to deletions, insertions, and other mutations in polypeptide sequences.

Altering level of production or expression: Changing, either by increasing or decreasing, the level of production or expression of a nucleic acid molecule or an amino acid molecule (for example an mRNA, a gene, a polypeptide, or a peptide), as compared to a control level of production or expression.

Amplification: When used in reference to a nucleic acid, this refers to techniques that increase the number of copies of a nucleic acid molecule in a sample or specimen. An example of amplification is the polymerase chain reaction, in which a biological sample collected from a subject is contacted with a pair of oligonucleotide primers, under conditions that allow for the hybridization of the primers to nucleic acid template in the sample. The primers are extended under suitable conditions, dissociated from the template, and then re-annealed, extended, and dissociated to amplify the number of copies of the nucleic acid. The product of in vitro amplification can be characterized by electrophoresis, restriction endonuclease cleavage patterns, oligonucleotide hybridization or ligation, and/or nucleic acid sequencing, using standard techniques. Other examples of in vitro amplification techniques include strand displacement amplification (see U.S. Pat. No. 5,744,311); transcription-free isothermal amplification (see U.S. Pat. No. 6,033,881); repair chain reaction amplification (see WO 90/01069); ligase chain reaction amplification (see EP-A-320 308); gap filling ligase chain reaction amplification (see U.S. Pat. No. 5,427,930); coupled ligase detection and PCR (see U.S. Pat. No. 6,027,889); and NASBA™ RNA transcription-free amplification (see U.S. Pat. No. 6,025,134).

Antisense, Sense, and Antigene: DNA has two antiparallel strands, a 5' →3' strand, referred to as the plus strand, and a 3' →5' strand, referred to as the minus strand. Because RNA polymerase adds nucleic acids in a 5' →3' direction, the minus strand of the DNA serves as the template for the RNA during transcription. Thus, an RNA transcript will have a sequence complementary to the minus strand, and identical to the plus strand (except that U is substituted for T).

Antisense molecules are molecules that are specifically hybridizable or specifically complementary to either RNA or the plus strand of DNA. Sense molecules are molecules that are specifically hybridizable or specifically complementary to the minus strand of DNA. Antigene molecules are either antisense or sense molecules directed to a DNA target. An antisense RNA (asRNA) is a molecule of RNA complementary to a sense (encoding) nucleic acid molecule.

cDNA (complementary DNA): A piece of DNA lacking internal, non-coding segments (introns) and transcriptional regulatory sequences. cDNA may also contain untranslated regions (UTRs) that are responsible for translational control in the corresponding RNA molecule. cDNA is usually synthesized in the laboratory by reverse transcription from messenger RNA extracted from cells or other samples.

Cell: Cell as used herein includes a plant cell, whether isolated, in tissue culture or incorporated in a plant or plant part.

Chimeric or Chimera: The product of the fusion of portions of two or more different polynucleotide or polypeptide molecules. For instance, the phrases "chimeric sequence" and "chimeric gene" refer to nucleotide sequences derived from at least two heterologous parts. Chimeric sequence may comprise DNA or RNA.

Chimeric transcription regulatory region: An array of nucleic acid control or regulatory sequences that direct transcription of a nucleic acid operably linked thereto, which array is assembled from different polynucleotide sources. For instance, chimeric transcription regulatory regions as described herein may be produced through manipulation of known promoters or other polynucleotide molecules. Chimeric transcription regulatory regions may combine one or more enhancer domains with one or more promoters, for example, by fusing a heterologous enhancer domain from a first native promoter to a second promoter with its own partial or complete set of regulatory element(s).

Construct: Any recombinant polynucleotide molecule such as a plasmid, cosmid, virus, autonomously replicating polynucleotide molecule, phage, or linear or circular single-stranded or double-stranded DNA or RNA polynucleotide molecule, derived from any source, capable of genomic integration or autonomous replication, comprising a polynucleotide molecule where one or more transcribable polynucleotide molecule has been operably linked.

Control plant: A plant that does not contain a recombinant DNA that confers (for instance) an enhanced or altered agronomic trait in a transgenic plant, is used as a baseline for comparison, for instance, in order to identify an enhanced or altered agronomic trait in the transgenic plant. A suitable control plant may be a non-transgenic plant of the parental line used to generate a transgenic plant, or a plant that at least is non-transgenic for the particular trait under examination (that is, the control plant may have been engineered to contain other heterologous sequences or recombinant DNA molecules). Thus, a control plant may in some cases be a transgenic plant line that comprises an empty vector or marker gene, but does not contain the recombinant DNA, or does not contain all of the recombinant DNAs, as in the test plant.

Crassulacean Acid Metabolism (CAM): A specialized form of photosynthesis found in about 6% of vascular plants. It is a carbon fixation pathway that evolved in some plants as an adaptation to arid conditions. In a plant using full CAM, the stomata in the leaves remain shut during the day to reduce evapotranspiration, but open at night to collect carbon dioxide ($CO_2$). The $CO_2$ is stored as the four-carbon acid malate in vacuoles at night, and then in the daytime, the malate is transported to chloroplasts where it is converted back to $CO_2$, which is then used during photosynthesis. The pre-collected $CO_2$ is concentrated around the enzyme RuBisCO, increasing photosynthetic efficiency. This metabolism was first studied in plants of the Crassulaceae family. These mainly include succulents. The first time it was studied, *Crassula* was used as a model organism.

DNA (deoxyribonucleic acid): DNA is a long chain polymer which comprises the genetic material of most organisms (some viruses have genes comprising ribonucleic acid (RNA)). The repeating units in DNA polymers are four different nucleotides, each of which comprises one of the four bases, adenine, guanine, cytosine and thymine bound to a deoxyribose sugar to which a phosphate group is attached. Triplets of nucleotides (referred to as codons) code for each amino acid in a polypeptide, or for a stop signal. The term codon is also used for the corresponding (and complementary) sequences of three nucleotides in the mRNA into which the DNA sequence is transcribed.

Unless otherwise specified, any reference to a DNA molecule includes the reverse complement of that DNA molecule. Except where single-strandedness is required by the text herein, DNA molecules, although written to depict only a single strand, encompass both strands of a double-stranded DNA molecule.

Encode: A polynucleotide is said to encode a polypeptide if, in its native state or when manipulated by methods known to those skilled in the art, the polynucleotide molecule can be transcribed and/or translated to produce a mRNA for and/or the polypeptide or a fragment thereof. The anti-sense strand is the complement of such a nucleic acid, and the encoding sequence can be deduced therefrom.

Enhancer domain: A cis-acting transcriptional regulatory element (a.k.a. cis-element) that confers an aspect of the overall control of gene expression. An enhancer domain may function to bind transcription factors, which are trans-acting protein factors that regulate transcription. Some enhancer domains bind more than one transcription factor, and transcription factors may interact with different affinities with more than one enhancer domain Enhancer domains can be identified by a number of techniques, including deletion analysis (deleting one or more nucleotides from the 5' end or internal to a promoter); DNA binding protein analysis using DNase I foot printing, methylation interference, electrophoresis mobility-shift assays, in vivo genomic foot printing by ligation-mediated PCR, and other conventional assays; or by DNA sequence comparison with known cis-element motifs using conventional DNA sequence comparison methods. The fine structure of an enhancer domain can be further studied by mutagenesis (or substitution) of one or more nucleotides or by other conventional methods. Enhancer domains can be obtained by chemical synthesis or by isolation from promoters that include such elements, and they can be synthesized with additional flanking nucleotides that contain useful restriction enzyme sites to facilitate subsequence manipulation.

(Gene) Expression: Transcription of a DNA molecule into a transcribed RNA molecule. More generally, the processes by which a gene's coded information is converted into the structures present and operating in the cell. Expressed genes include those that are transcribed into mRNA and then translated into protein and those that are transcribed into RNA, but not translated into protein (for example, siRNA, transfer RNA and ribosomal RNA). Thus, expression of a target sequence, such as a gene or a promoter region of a gene, can result in the expression of an mRNA, a protein, or both. The expression of the target sequence can be inhibited or enhanced (decreased or increased). Gene expression may be described as related to temporal, spatial, developmental, or morphological qualities as well as quantitative or qualitative indications.

Gene regulatory activity: The ability of a polynucleotide to affect transcription or translation of an operably linked transcribable or translatable polynucleotide molecule. An isolated polynucleotide molecule having gene regulatory activity may provide temporal or spatial expression or modulate levels and rates of expression of the operably linked transcribable polynucleotide molecule. An isolated polynucleotide molecule having gene regulatory activity may include a promoter, intron, leader, or 3' transcription termination region.

Heterologous: A type of sequence that is not normally (e.g., in the wild-type sequence) found adjacent to a second sequence. In one embodiment, the sequence is from a different genetic source, such as a virus or organism or species, than the second sequence.

Hybridization: Oligonucleotides and their analogs hybridize by hydrogen bonding, which includes Watson-Crick, Hoogsteen or reversed Hoogsteen hydrogen bonding, between complementary bases. Generally, nucleic acid consists of nitrogenous bases that are either pyrimidines (cytosine (C), uracil (U), and thymine (T)) or purines (adenine (A) and guanine (G)). These nitrogenous bases form hydrogen bonds between a pyrimidine and a purine, and the bonding of the pyrimidine to the purine is referred to as base pairing. More specifically, A will hydrogen bond to T or U, and G will bond to C. In RNA molecules, G also will bond to U. Complementary refers to the base pairing that occurs between two distinct nucleic acid sequences or two distinct regions of the same nucleic acid sequence.

Hybridization conditions resulting in particular degrees of stringency will vary depending upon the nature of the hybridization method of choice and the composition and length of the hybridizing nucleic acid sequences. Generally, the temperature of hybridization and the ionic strength (especially the Na concentration) of the hybridization buffer will determine the stringency of hybridization. Calculations regarding hybridization conditions required for attaining particular degrees of stringency are discussed by Sambrook et al. (ed.), *Molecular Cloning: A Laboratory Manual*, 2nd ed., vol. 1-3, Cold Spring Harbor Laboratory Press, Cold Spring Harbor, N.Y., 1989, chapters 9 and 11, herein incorporated by reference.

The following is an exemplary set of hybridization conditions and is not meant to be limiting.
Very High Stringency (Detects Sequences that Share 90% Sequence Identity)
　Hybridization: 5×SSC at 65° C. for 16 hours
　Wash twice: 2×SSC at room temperature (RT) for 15 minutes each
　Wash twice: 0.5×SSC at 65° C. for 20 minutes each
High Stringency (Detects Sequences that Share 80% Sequence Identity or Greater)
　Hybridization: 5×-6×SSC at 65° C.–70° C. for 16-20 hours
　Wash twice: 2×SSC at RT for 5-20 minutes each
　Wash twice: 1×SSC at 55° C.–70° C. for 30 minutes each
Low Stringency (Detects Sequences that Share Greater than 50% Sequence Identity)
　Hybridization: 6×SSC at RT to 55° C. for 16-20 hours
　Wash at least twice: 2×-3×SSC at RT to 55° C. for 20-30 minutes each.

In cis: Indicates that two sequences are positioned on the same piece of RNA or DNA.

In trans: Indicates that two sequences are positioned on different pieces of RNA or DNA.

Industrial crop: Crops grown primarily for consumption by humans or animals or for use in industrial processes (for example, as a source of fatty acids for manufacturing or sugars for producing alcohol). It will be understood that in many instances either the plant or a product produced from the plant (for example, sweeteners, oil, flour, or meal) can be consumed; thus, a subset of industrial crops are food crops. Examples of food crops include, but are not limited to, corn, soybean, rice, wheat, oilseed rape, tomato, cotton, oats, barley, tobacco, Camelina and potato plants. Other examples of industrial crops (including food crops) are listed herein.

Increased Expression: Gene upregulation includes any detectable increase in the production of a gene product. In certain examples, production of a gene product increases by at least 2-fold, for example at least 3-fold or at least 4-fold, as compared to a control (such an amount of gene expression in a wild-type cell).

Isolated: An "isolated" biological component (such as a nucleic acid, peptide or protein) has been substantially separated, produced apart from, or purified away from other biological components in the cell of the organism in which the component naturally occurs, e.g., other chromosomal and extrachromosomal DNA and RNA, and proteins. Nucleic acids, peptides and proteins which have been "isolated" thus include nucleic acids and proteins purified by standard purification methods. The term also embraces nucleic acids, peptides and proteins prepared by recombinant expression in a host cell as well as chemically synthesized nucleic acids.

Metabolome: The complement of relatively low molecular weight molecules (metabolites) that is present in a single organism, a sample, a tissue, a cell, or whatever other division is divided. By way of example, metabolomes may include metabolic intermediates, hormones and other signaling molecules, and secondary metabolites. Representative metabolomes comprise the complement of metabolites found within a biological sample, such as a plant, plant part, or plant sample, or in a suspension or extract thereof. Examples of such molecules include, but are not limited to: acids and related compounds; mono-, di-, and tri-carboxylic acids (saturated, unsaturated, aliphatic and cyclic, aryl, alkaryl); aldo-acids, keto-acids; lactone forms; gibberellins; abscisic acid; alcohols, polyols, derivatives, and related compounds; ethyl alcohol, benzyl alcohol, methanol; propylene glycol, glycerol, phytol; inositol, furfuryl alcohol, menthol; aldehydes, ketones, quinones, derivatives, and related compounds; acetaldehyde, butyraldehyde, benzaldehyde, acrolein, furfural, glyoxal; acetone, butanone; anthraquinone; carbohydrates; mono-, di-, tri-saccharides; alkaloids, amines, and other bases; pyridines (including nicotinic acid, nicotinamide); pyrimidines (including cytidine, thymine); purines (including guanine, adenine, xanthines/hypoxanthines, kinetin); pyrroles; quinolines (including isoquinolines); morphinans, tropanes, cinchonans; nucleotides, oligonucleotides, derivatives, and related compounds; guanosine, cytosine, adeno sine, thymidine, inosine; amino acids, oligopeptides, derivatives, and related compounds; esters; phenols and related compounds; heterocyclic compounds and derivatives; pyrroles, tetrapyrroles (corrinoids and porphines/porphyrins, w/w/o metal-ion); flavonoids; indoles; lipids (including fatty acids and triglycerides), derivatives, and related compounds; carotenoids, phytoene; and sterols, isoprenoids including terpenes.

Native or wild-type relative to a given plant trait or phenotype: A reference to the form in which that trait or phenotype is found in the same variety of plant in nature.

Nucleotide: The term nucleotide includes, but is not limited to, a monomer that includes a base linked to a sugar, such as a pyrimidine, purine or synthetic analogs thereof, or a base linked to an amino acid, as in a peptide nucleic acid (PNA). A nucleotide is one monomer in an oligonucleotide/polynucleotide. A nucleotide sequence refers to the sequence of bases in an oligonucleotide/polynucleotide.

The major nucleotides of DNA are deoxyadenosine 5'-triphosphate (dATP or A), deoxyguanosine 5'-triphosphate (dGTP or G), deoxycytidine 5'-triphosphate (dCTP or C) and deoxythymidine 5'-triphosphate (dTTP or T). The major nucleotides of RNA are adenosine 5'-triphosphate (ATP or A), guanosine 5'-triphosphate (GTP or G), cytidine 5'-triphosphate (CTP or C) and uridine 5'-triphosphate (UTP or U). Inosine is also a base that can be integrated into DNA or RNA in a nucleotide (dITP or ITP, respectively).

Oligonucleotide: An oligonucleotide is a plurality of nucleotides joined by phosphodiester bonds, between about 6 and about 300 nucleotides in length. An oligonucleotide analog refers to compounds that function similarly to oligonucleotides but have non-naturally occurring portions. For example, oligonucleotide analogs can contain non-naturally occurring portions, such as altered sugar moieties or inter-sugar linkages, such as a phosphorothioate oligodeoxynucleotide. Functional analogs of naturally occurring polynucleotides can bind to RNA or DNA Operably linked: This term refers to a juxtaposition of components, particularly nucleotide sequences, such that the normal function of the components can be performed. Thus, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Generally, operably linked DNA sequences are contiguous and, where necessary to join two protein-coding regions, in the same reading frame. A coding sequence that is "operably linked" to regulatory sequence(s) refers to a configuration of nucleotide sequences wherein the coding sequence can be expressed under the regulatory control (e.g., transcriptional and/or translational control) of the regulatory sequences.

ORF (open reading frame): A series of nucleotide triplets (codons) coding for amino acids without any termination codons. These sequences are usually translatable into a peptide.

Plant: Any plant and progeny thereof. The term also includes parts of plants, including seed, cuttings, tubers, fruit, flowers, etc. In various embodiments, the term plant refers to cultivated plant species, such as corn, cotton, canola, sunflower, soybeans, sorghum, alfalfa, wheat, rice, plants producing fruits and vegetables, and turf and ornamental plant species. The term plant cell, as used herein, refers to the structural and physiological unit of plants, consisting of a protoplast and the surrounding cell wall. The term plant organ, as used herein, refers to a distinct and visibly differentiated part of a plant, such as root, stem, leaf or embryo. More generally, the term plant tissue refers to any tissue of a plant in planta or in culture. This term includes a whole plant, plant cell, plant organ, protoplast, cell culture, or any group of plant cells organized into a structural and functional unit. Plant height. Plant height is taken from the top of the soil to the tip of the plant, and is typically measured in centimeters or inches. Plant parts. Includes protoplasts, leaves, stems, roots, root tips, anthers, pistils, seed, embryo, pollen, ovules, cotyledon, hypocotyl, flower, shoot, tissue, petiole, cells, calli, pods, meristematic cells and the like. Includes plant cells of a tissue culture from which soybean plants can be regenerated.

Polynucleotide molecule: Single- or double-stranded DNA or RNA of genomic or synthetic origin; that is, a polymer of deoxyribonucleotide or ribonucleotide bases, respectively, read from the 5' (upstream) end to the 3' (downstream) end.

Polypeptide molecule: A polymer in which the monomers are amino acid residues which are joined together through amide bonds. When the amino acids are alpha-amino acids, either the L-optical isomer or the D-optical isomer can be used, the L-isomers being preferred. The term polypeptide or protein as used herein encompasses any amino acid sequence and includes modified sequences such as glycoproteins. The term polypeptide is specifically intended to cover naturally occurring proteins, as well as those that are recombinantly or synthetically produced.

Progeny. Offspring; descendants.

Promoter: An array of nucleic acid control sequences which direct transcription of a nucleic acid, by recognition and binding of e.g., RNA polymerase II and other proteins (trans-acting transcription factors) to initiate transcription. A promoter includes necessary nucleic acid sequences near the start site of transcription, such as, in the case of a polymerase II type promoter, a TATA element. Minimally, a promoter typically includes at least an RNA polymerase binding site together and may also include one or more transcription factor binding sites which modulate transcription in response to occupation by transcription factors. Representative examples of promoters (and elements that can be assembled to produce a promoter) are described herein. Promoters may be defined by their temporal, spatial, or developmental expression pattern.

A plant promoter is a native or non-native promoter that is functional in plant cells.

Protein: A biological molecule, for example a polypeptide, expressed by a gene and comprised of amino acids.

Protoplast: An isolated plant cell without a cell wall, having the potential for being transformed and/or regeneration into cell culture or a whole plant.

Purified: The term purified does not require absolute purity; rather, it is intended as a relative term. Thus, for example, a purified fusion protein preparation is one in which the fusion protein is more enriched than the protein is in its generative environment, for instance within a cell or in a biochemical reaction chamber. Preferably, a preparation of fusion protein is purified such that the fusion protein represents at least 50% of the total protein content of the preparation.

Recombinant: A recombinant nucleic acid is one that has a sequence that is not naturally occurring or has a sequence that is made by an artificial combination of two otherwise separated segments of sequence. This artificial combination is often accomplished by chemical synthesis or, more commonly, by the artificial manipulation of isolated segments of nucleic acids, e.g., by genetic engineering techniques.

Similarly, a recombinant protein is one encoded for by a recombinant nucleic acid molecule.

Regulatable promoter: A promoter with activity of which is regulated (directly or indirectly) by an agent, such as a transcription factor, a chemical compound, an environmental condition, or a nucleic acid molecule.

Regulating gene expression: Processes of controlling the expression of a gene by increasing or decreasing the expression, production, or activity of an agent that affects gene expression. The agent can be a protein, such as a transcription factor, or a nucleic acid molecule which when in contact with the gene or its upstream regulatory sequences, or a mRNA encoded by the gene, either increases or decreases gene expression.

Regulatory sequences or elements: These terms refer generally to a class of polynucleotide molecules (such as DNA molecules, having DNA sequences) that influence or control transcription or translation of an operably linked transcribable polynucleotide molecule, and thereby expression of genes. Included in the term are promoters, enhancers, leaders, introns, locus control regions, boundary elements/insulators, silencers, matrix attachment regions (also referred to as scaffold attachment regions), repressor, transcriptional terminators (also known as transcription termination regions), origins of replication, centromeres, and meiotic recombination hotspots. Promoters are sequences of DNA near the 5' end of a gene that act as a binding site for RNA polymerase, and from which transcription is initiated. Enhancers are control elements that elevate the level of transcription from a promoter, usually independently of the enhancer's orientation or distance from the promoter. Locus control regions (LCRs) confer tissue-specific and temporally regulated expression to genes to which they are linked. LCRs function independently of their position in relation to the gene, but are copy-number dependent. It is believed that they function to open the nucleosome structure, so other factors can bind to the DNA. LCRs may also affect replication timing and origin usage. Insulators (also known as boundary elements) are DNA sequences that prevent the activation (or inactivation) of transcription of a gene, by blocking effects of surrounding chromatin. Silencers and repressors are control elements that suppress gene expression; they act on a gene independently of their orientation or distance from the gene. Matrix attachment regions (MARs), also known as scaffold attachment regions, are sequences within DNA that bind to the nuclear scaffold. They can affect transcription, possibly by separating chromosomes into regulatory domains. It is believed that MARs mediate higher-order, looped structures within chromosomes. Transcriptional terminators are regions within the gene vicinity that RNA polymerase is released from the template. Origins of replication are regions of the genome that, during DNA synthesis or replication phases of cell division, begin the replication process of DNA. Meiotic recombination hotspots are regions of the genome that recombine more frequently than the average during meiosis. Specific nucleotides within a regulatory region may serve multiple functions. For example, a specific nucleotide may be part of a promoter and participate in the binding of a transcriptional activator protein.

Isolated regulatory elements that function in cells (for instance, in plants or plant cells) are useful for modifying plant phenotypes, for instance through genetic engineering.

RNA: A typically linear polymer of ribonucleic acid monomers, linked by phosphodiester bonds. Naturally occurring RNA molecules fall into three general classes, messenger (mRNA, which encodes proteins), ribosomal (rRNA, components of ribosomes), and transfer (tRNA, molecules responsible for transferring amino acid monomers to the ribosome during protein synthesis). Messenger RNA includes heteronuclear (hnRNA) and membrane-associated polysomal RNA (attached to the rough endoplasmic reticulum). Total RNA refers to a heterogeneous mixture of all types of RNA molecules.

Regeneration. The development of a plant from tissue culture. The cells may, or may, not have been genetically modified. Plant tissue culture relies on the fact that all plant cells have the ability to generate a whole plant (totipotency). Single cells (protoplasts), pieces of leaves, or roots can often be used to generate a new plant on culture media given the required nutrients and plant hormones.

Seed. The part of a flowering plant that typically contains the embryo with its protective coat and stored food and that can develop into a new plant under the proper conditions; fertilized and mature ovule.

Seed quality: The visual rating of the completeness of the seed. The score is based on the completeness of the seed coat and overall soundness of the seed. Scores range from 1 to 5, with a score of 1 indicating good quality seed and a score of 5 indicating the seeds are of poor quality.

Seed yield: The yield in bushels/acre (bu/a) and is the actual yield of the grain at harvest.

Sequence identity: The similarity between two nucleic acid sequences, or two amino acid sequences is expressed in terms of the similarity between the sequences, otherwise referred to as sequence identity. Sequence identity is frequently measured in terms of percentage identity (or similarity or homology); the higher the percentage, the more similar the two sequences are. Homologs of the sequences referenced or disclosed herein will possess a relatively high degree of sequence identity when aligned using standard methods.

Methods of alignment of sequences for comparison are well known in the art. Various programs and alignment algorithms are described in: Smith and Waterman (*Adv. Appl. Math.* 2: 482, 1981); Needleman and Wunsch (*J. Mol. Biol.* 48: 443, 1970); Pearson and Lipman (*PNAS. USA* 85: 2444, 1988); Higgins and Sharp (Gene, 73: 237-244, 1988); Higgins and Sharp (*CABIOS* 5: 151-153, 1989); Corpet et al. (*Nuc. Acids Res.* 16: 10881-90, 1988); Huang et al. (*Comp. Appls Biosci.* 8: 155-65, 1992); and Pearson et al. (*Methods in Molecular Biology* 24: 307-31, 1994). Altschul et al. (*Nature Genet.*, 6: 119-29, 1994) presents a detailed consideration of sequence alignment methods and homology calculations.

The alignment tools ALIGN (Myers and Miller, *CABIOS* 4: 11-17, 1989) or LFASTA (Pearson and Lipman, 1988) may be used to perform sequence comparisons (Internet Program ©1996, W. R. Pearson and the University of Virginia, "fasta20u63" version 2.0u63, release date December 1996). ALIGN compares entire sequences against one another, while LFASTA compares regions of local similarity. These alignment tools and their respective tutorials are available on the Internet at biology.ncsa.uiuc.edu.

Orthologs or paralogs (more generally, homologs) of the disclosed sequences are typically characterized by possession of greater than 75% sequence identity counted over the full-length alignment with the sequence to which they are compared using ALIGN set to default parameters. Sequences with even greater similarity to the reference sequences will show increasing percentage identities when assessed by this method, such as at least 80%, at least 85%, at least 90%, at least 92%, at least 95%, or at least 98% sequence identity. In addition, sequence identity can be compared over the full length of one or both binding domains of the disclosed fusion proteins. In such an instance, percentage identities will be essentially similar to those discussed for full-length sequence identity.

When significantly less than the entire sequence is being compared for sequence identity, homologs will typically possess at least 80% sequence identity over short windows of 10-20 amino acids, and may possess sequence identities of at least 85%, at least 90%, at least 95%, or at least 99% depending on their similarity to the reference sequence. Sequence identity over such short windows can be determined using LFASTA; methods can be found at World Wide Web address biology.ncsa.uiuc.edu.

One of skill in the art will appreciate that these sequence identity ranges are provided for guidance only; it is entirely possible that strongly significant homologs could be obtained that fall outside of the ranges provided.

An alternative indication that two nucleic acid molecules are closely related is that the two molecules hybridize to each other under stringent conditions. Stringent conditions are sequence-dependent and are different under different environmental parameters. Generally, stringent conditions are selected to be about 5° C. to 20° C. lower than the thermal melting point ($T_m$) for the specific sequence at a defined ionic strength and pH. The $T_m$ is the temperature (under defined ionic strength and pH) at which 50% of the target sequence hybridizes to a perfectly matched probe. Conditions for nucleic acid hybridization and calculation of stringencies can be found in Sambrook et al. (In *Molecular Cloning: A Laboratory Manual*, Cold Spring Harbor, N.Y., 1989) and Tijssen (*Laboratory Techniques in Biochemistry and Molecular Biology* Part I, Ch. 2, Elsevier, New York, 1993). Nucleic acid molecules that hybridize under stringent conditions typically hybridize to a probe based on either the entire fusion protein encoding sequence, an entire binding domain, or other selected portions of the encoding sequence under wash conditions of 0.2×SSC, 0.1% SDS at 65° C.

Nucleic acid sequences that do not show a high degree of identity may nevertheless encode similar amino acid sequences, due to the degeneracy of the genetic code. It is understood that changes in nucleic acid sequence can be made using this degeneracy to produce multiple nucleic acid sequences that each encode substantially the same protein.

Tissue culture: A composition that includes isolated cells of the same or a different type or a collection of such cells organized into parts of a plant.

Transcription: The production of an RNA molecule by RNA polymerase as a complementary copy of a DNA sequence.

Transcription termination region: Sequences that control formation of the 3' end of a transcript. Self-cleaving ribozymes and polyadenylation sequences are examples of transcription termination sequences.

Transformation: Process by which exogenous DNA enters and changes a recipient cell. It may occur under natural conditions, or artificial conditions using various methods well known in the art. Transformation may rely on any known method for the insertion of foreign nucleic acid sequences into a prokaryotic or eukaryotic host cell. Selection of the method is influenced by the host cell being transformed and may include, but is not limited to, viral infection, *Agrobacterium*-mediated gene transfer, electroporation, lipofection, and particle bombardment.

Transformed: A transformed cell is a cell into which has been introduced a nucleic acid molecule by molecular biology techniques. Transformed cells include stably transformed cells in which the inserted DNA is capable of replication either as an autonomously replicating plasmid or as part of the host chromosome. They also include cells that transiently express the inserted DNA or RNA for limited periods of time. As used herein, the term transformation encompasses all techniques by which a nucleic acid molecule might be introduced into such a cell, including transfection with viral vectors, transformation with plasmid vectors, and introduction of naked DNA by electroporation, lipofection, and particle gun acceleration.

Transgene. A gene or genetic material that has been transferred into the genome of a plant, for example by genetic engineering methods. Exemplary transgenes include cDNA (complementary DNA) segment, which is a copy of mRNA (messenger RNA), and the gene itself residing in its original region of genomic DNA. In one example, describes a segment of DNA containing a gene sequence that is introduced into the genome of a plant or plant cell. This non-native segment of DNA may retain the ability to produce RNA or protein in the transgenic plant, or it may alter the normal function of the transgenic plant's genetic code. In general, the transferred nucleic acid is incorporated into the plant's germ line. Transgene can also describe any DNA sequence, regardless of whether it contains a gene coding sequence or it has been artificially constructed, which has been introduced into a plant or vector construct in which it was previously not found.

Transgenic: This term refers to a plant/cell/other entity or organism that contains recombinant genetic material not normally found in entities of this type/species (that is, heterologous genetic material) and which has been introduced into the entity in question (or into progenitors of the entity) by human manipulation. Thus, a plant that is grown from a plant cell into which recombinant DNA is introduced by transformation (a transformed plant cell) is a transgenic plant, as are all offspring of that plant that contain the introduced transgene (whether produced sexually or asexually).

Transgenic plant: A plant that contains a foreign (heterologous) nucleotide sequence inserted into either its nuclear genome or organellar genome.

Transposon: A nucleotide sequence such as a DNA or RNA sequence that is capable of transferring location or moving within a gene, a chromosome or a genome.

Vector: A nucleic acid molecule as introduced into a host cell, thereby producing a transformed host cell. A vector may include nucleic acid sequences that permit it to replicate in the host cell, such as an origin of replication. A vector may also include one or more therapeutic genes and/or selectable marker genes and other genetic elements known in the art. A vector can transduce, transform or infect a cell, thereby causing the cell to express nucleic acids and/or proteins other than those native to the cell. A vector optionally includes materials to aid in achieving entry of the nucleic acid into the cell, such as a viral particle, liposome, protein coating or the like.

III. Description of Several Embodiments

A. Methods and Compositions

Methods of altering CAM pathways in plants are disclosed herein. In some examples, the method comprises overexpressing one or more genes encoding one or more enzymes that carry out the basic biochemical sequence of nocturnal $CO_2$ fixation (carboxylation) into $C_4$ acids (malate), store $C_4$ acids in the vacuole of the plant, and/or then decarboxylate and refix the released $CO_2$ by $C_3$ photosynthesis during the subsequent day in a plant cell, thereby altering CAM in the plant cell.

In some embodiments, a method comprises overexpressing one or more genes involved in carboxylation, one or more genes involved in decarboxylation, and/or one or more genes encoding malate transport functions in a plant cell, thereby altering CAM in the plant cell. In one embodiment, the one or more genes comprise McBca2 (Beta carbonic anhydrase 2), McPpck (phosphoenolpyruvate carboxylase kinase), McPpc1 (phosphoenolpyruvate carboxylase), McNAD-Mdh2 [NAD(P) malate dehydrogenase 2], McALMT4 (putative aluminum-activated malate transporter for tonoplast localization), MctDT (tonoplast dicarboxylate transporter), McNADP-ME3 (NADP-dependent malic enzyme 3), McPpdk1 (pyruvate orthophosphate dikinase), and/or McPpdk-RP (pyruvate orthophosphate dikinase-regulatory protein). In some examples, the sequence includes full-length wild-type (or native) sequence, as well as allelic variants, fragments, homologs or fusion sequences that retain the ability to be expressed at increased levels in a plant cell and regulate CAM, such as increase CAM. In certain examples, the sequence has at least 80% sequence identity, for example at least 85%, at least 91%, at least 92%, at least 93%, at least 94%, at least 95%, at least 96%, at least 97%, at least 98%, or at least 99% sequence identity to a wild-type sequence for McBca2 (Beta carbonic anhydrase 2; SEQ ID NO: 1; GenBank sequence ID: JN228099.1 hereby incorporated by reference as available on Jan. 6, 2017), McPpck (phosphoenolpyruvate carboxylase kinase; SEQ ID NO: 2; GenBank sequence ID: AF158091.1 hereby incorporated by reference as available on Jan. 6, 2017), McPpc1 (phosphoenolpyruvate carboxylase; SEQ ID NO: 3; GenBank sequence ID: X13660.1 hereby incorporated by reference as available on Jan. 6, 2017), McNAD-Mdh2 [NAD(P) malate dehydrogenase 2] (SEQ ID NO: 4; GenBank sequence ID: X96539.1 hereby incorporated by reference as available on Jan. 6, 2017), McALMT4 (putative aluminum-activated malate transporter; SEQ ID NO: 5; GenBank sequence ID: XM_019002905.1 hereby incorporated by reference as available on Jan. 6, 2017), MctDT (tonoplast dicarboxylate transporter; SEQ ID NO: 6; GenBank sequence ID: XM_010688412.2 hereby incorporated by reference as available on Jan. 6, 2017), McNADP-ME3 (NADP-dependent malic enzyme 3; SEQ ID NO: 7; GenBank sequence ID: X64434.1 hereby incorporated by reference as available on Jan. 6, 2017), McPpdk1 (pyruvate orthophosphate dikinase; SEQ ID NO: 8; GenBank sequence ID: X78347.1 hereby incorporated by reference as available on Jan. 6, 2017), and/or McPpdk-RP (pyruvate orthophosphate dikinase-regulatory protein; SEQ ID NO: 9; GenBank sequence ID: XM_010054134.2 hereby incorporated by reference as available on Jan. 6, 2017). In some embodiments, a disclosed polynucleotide sequence is one provided in Tables 1-5. In some embodiments, the method further comprises overexpressing one or more tissue succulent regulating factors, such as overexpressing a basic helix-loop-helix transcription factor CEB1, such as a codon optimized CEB1 or functional fragment thereof as disclosed in Application No. 62/255,158, filed on Nov. 13, 2015 and PCT/US2016/06177, filed on Nov. 13, 2016, each of which is hereby incorporated by reference in its entirety.

In some embodiments, the method comprises overexpression one or more genes involved in carboxylation (e.g., McBca2, McPpc1, McPpck, and McNAD-Mdh2), one or more genes involved in decarboxylation module (e.g., McNADP-ME3, McPpdk1, and McPpdk-RP), and one or more genes involved in malate transport functions (McALMT4 and MctDT). In some examples, the method comprises overexpression of four genes involved in carboxylation (McBca2, McPpc1, McPpck, and McMdh2), three genes involved in decarboxylation module (McNADP-ME3, McPpdk1, and McPpdk-RP), and two genes encoding malate transport functions (McALMT4 and MctDT).

In some embodiments, a method includes operably linking a disclosed polynucleotide sequence to a circadianly-controlled 5' regulatory region, such as an *Arabidopsis thaliana* promoter that confers the correct temporal expression pattern necessary to carry out the proper biochemical sequence of enzymatic reactions and transport steps. For example, each promoter confers increased expression of their respective transgene under conditions of water-deficit stress so that the CAM pathway is operational largely under water-deficit conditions.

In some embodiments, a disclosed polynucleotide sequence comprises a gypsy barrier insulators which prevent transcriptional interference from adjacent transcriptional cassettes and gene silencing, were included into each expression cassette to prevent or decrease transgene silencing. In some embodiments, a disclosed polynucleotide can further comprise a unique epitope tag to monitor transgene expression within the plant.

In embodiments, the method includes inserting a disclosed CAM regulating nucleic acid sequence into a vector construct and transforming the plant cell with the generated vector construct.

In some embodiments, a disclosed vector construct comprises a full-length wild-type (or native) sequence, allelic variants, fragments, homologs or fusion sequences that retains the ability to be expressed at increased levels in a plant cell, such as a polynucleotide sequence has at least 80% sequence identity, for example at least 85%, 90%, 95%, or 98% sequence identity to a wild-type sequence encoding McBca2 (Beta carbonic anhydrase 2), McPpck (phosphoenolpyruvate carboxylase kinase), McPpc1 (phosphoenolpyruvate carboxylase), McNAD-Mdh2 [NAD(P) malate dehydrogenase 2], McALMT4 (putative aluminum-activated malate transporter), MctDT (tonoplast dicarboxylate transporter), McNADP-ME3 (NADP-dependent malic enzyme 3), McPpdk1 (pyruvate orthophosphate dikinase), and/or McPpdk-RP (pyruvate orthophosphate dikinase-regulatory protein).

To routinely identify biologically active proteins, amino acid substitutions may be based on any characteristic known in the art, including the relative similarity or differences of the amino acid side-chain substituents, for example, their hydrophobicity, hydrophilicity, charge, size, and the like. Generally, nucleotide sequence variants will encode a protein have at least 80% sequence identity to the protein encoded by a disclosed nucleic acid, such as a nucleic acid sequence at least 80%, at least 85%, at least 90%, at least 91%, at least 92%, at least 93%, at least 94%, at least 95%, at least 96%, at least 97%, at least 98% or at least 99% sequence identity or even greater to the protein encoded by its respective reference nucleotide sequence.

In some embodiments, a disclosed nucleic acid encodes a functional fragment of a CAM regulatory protein. Such functional fragments still exhibit CAM regulatory activity. Functional fragments include proteins in which residues at the N-terminus, C-terminus and/or internal to the full-length protein have been deleted. For example, a deletion of less than about 50, 40, 30, 25, 20, 15, 10, 5, 4, 3, 2, or 1 amino acids from the N-terminus, C-terminus and/or internal loops can be made while maintaining the active site with minimal testing and/or experimentation to determine the activity of the resultant protein. Also disclosed are isolated proteins that have at least 80% sequence homology to the polypeptide encoded by a nucleic acid with nucleic acid sequence set forth by one of SEQ ID NOs:1-9 or a degenerate nucleic acid, such as a nucleic acid sequence at least 80%, at least 85%, at least 90%, at least 91%, at least 92%, at least 93%, at least 94%, at least 95%, at least 96%, at least 97%, at least 98%, or at least 99% sequence identity or even greater to the protein encoded by a nucleic acid sequence set forth by one of SEQ ID NOs: 1-9.

The disclosed nucleotide sequences, including one having at least 80% sequence homologs to the nucleic acid sequence set forth by one of SEQ ID NOs: 1-9, such as at least 80%, at least 85%, at least 90%, at least 91%, at least 92%, at least 93%, at least 94%, at least 95%, at least 96%, at least 97%, at least 98% or at least 99% to the nucleic acid sequence set forth by one of SEQ ID NOs: 1-9 or a degenerate, or functional fragment thereof, are useful in the genetic manipulation plant cells when operably linked with a promoter, such as an indictable or constitutive promoter. In this manner, the nucleotide sequences are provided in expression cassettes for expression in the plant of interest. Such expression cassettes will typically comprise a transcriptional initiation region comprising a promoter nucleotide sequence operably linked to one or more of the disclosed nucleic acids or variants thereof. Such an expression cassette can be provided with a plurality of restriction sites for insertion of the nucleotide sequence to be under the transcriptional regulation of the regulatory regions. The expression cassette may additionally contain selectable marker genes or sequences. The expression cassettes of this disclosure can be part of and an expression vector, such as a plasmid.

In some embodiments, the transcriptional cassette will include in the 5'-to-3' direction of transcription, a transcriptional and translational initiation region, a nucleic acid sequence encoding a CAM regulatory protein or functional fragment thereof, and a transcriptional and translational termination region functional in plant cells. The termination region may be native with the transcriptional initiation region, may be native with the CEB1, or may be derived from another source. Convenient termination regions are available from the Ti-plasmid of A. tumefaciens, such as the octopine synthase and nopaline synthase termination regions. See also, Guerineau et al., Mol. Gen. Genet. 262: 141-144, 1991; Proudfoot Cell 64:671-674, 1991; Sanfacon et al., Genes Dev. 5:141-149, 1991; Mogen et al., Plant Cell 2:1261-1272, 1990; Munroe et al., Gene 91:151-158, 1990; Ballas et al., Nucleic Acids Res. 17:7891-7903, 1989; Joshi et al., Nucleic Acid Res. 15:9627-9639, 1987.

An expression cassette including a disclosed nucleic acid sequence operably linked to a promoter sequence may also contain at least additional nucleotide sequence for a gene to be co-transformed into the organism. Alternatively, the additional sequence(s) can be provided on another expression cassette. Additional sequence modifications are known to enhance gene expression in a cellular host. These include elimination of sequences encoding spurious polyadenylation signals, exon-intron splice site signals, transposon-like repeats, and other such well-characterized sequences that may be deleterious to gene expression. The G-C content of the heterologous nucleotide sequence may be adjusted to levels average for a given cellular host, as calculated by reference to known genes expressed in the host cell. When possible, the sequence is modified to avoid predicted hairpin secondary mRNA structures.

The expression cassettes may additionally contain 5' leader sequences in the expression cassette construct. Such leader sequences can act to enhance translation. Translation leaders are known in the art and include: picornavirus leaders, for example, EMCV leader (Encephalomyocarditis 5' noncoding region) (Elroy-Stein et al., Proc. Nat. Acad. Sci. USA 86:6126-6130, 1989); potyvirus leaders, for example, TEV leader (Tobacco Etch Virus); MDMV leader (Maize Dwarf Mosaic Virus); human immunoglobulin heavy-chain binding protein (BiP) (Macejak and Sarnow Nature 353:90-94, 1991); untranslated leader from the coat protein mRNA of alfalfa mosaic virus (AMV RNA 4) (Jobling and Gehrke Nature 325:622-625, 1987); tobacco mosaic virus leader (TMV) (Gallie et al. Molecular Biology of RNA, pages 237-256, 1989; and maize chlorotic mottle virus leader (MCMV) (Lommel et al., Virology 81:382-385, 1991). See also Della-Cioppa et al., Plant Physiology 84:965-968, 1987. Other methods known to enhance translation and/or mRNA stability can also be utilized, for example, introns, and the like.

In some embodiments, a disclosed isolated polynucleotide sequences comprises a plant promoter and a polynucleotide sequence involved in CAM regulation, such as a modified nucleic sequence sharing at least 80%, at least 85%, at least 90%, at least 91%, at least 92%, at least 93%, at least 94%, at least 95%, at least 96%, at least 97%, at least 98%, or at least 99% sequence identity or even greater to a nucleic acid sequence set forth by one of SEQ ID NOs: 1-9, and is capable of regulating CAM. In some examples, the polynucleotide sequence comprises the plant promoter is CaMV35S operably linked to a disclosed nucleic acid sequence. Numerous promoters useful for heterologous gene expression are available including, but not limited to, E4 (U.S. Pat. Nos. 5,783,393 and 5,783,394), CaMV19S, CaMVV1, Act1, Ubi1, or CsVMV promoters.

In those instances where it is desirable to have the expressed product directed to a particular organelle, such as the chloroplast or mitochondrion, or secreted at the cell's surface or extracellularly, the expression cassette may further comprise a coding sequence for a transit peptide. Such transit peptides are well known in the art and include, but are not limited to, the transit peptide for the acyl carrier protein, the small subunit of RUBISCO, plant EPSP synthase, and the like.

In preparing the expression cassette, the various DNA fragments may be manipulated by methods known in the art, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, for example, transitions and transversions, may be involved.

The expression cassettes may include reporter genes or selectable marker genes. Examples of suitable reporter genes known in the art can be found in, for example, Jefferson et al. in Plant Molecular Biology Manual, ed. Gelvin et al. (Kluwer Academic Publishers), pp. 1-33, 1991; DeWet et al., Mol. Cell. Biol. 7:725-737, 1987; Goff et al., EMBO J. 9:2517-2522, 1990; and Kain et al., BioTechniques 19:650-655, 1995; and Chiu et al., Current Biology 6:325-330, 1996. Selectable marker genes for selection of transformed cells or tissues can include genes that confer antibiotic resistance or resistance to herbicides. Examples of suitable selectable marker genes include, but are not limited to, genes encoding resistance to chloramphenicol (Herrera Estrella et al., EMBO J. 2:987-992, 1983); methotrexate (Herrera Estrella et al., Nature 303:209-213, 1983; Meijer et al., Plant Mol. Biol. 16:807-820, 1991); hygromycin (Waldron et al., Plant Mol. Biol. 5:103-108, 1985; Zhijian et al., Plant Science 108:219-227, 1995); streptomycin (Jones et al., Mol. Gen. Genet. 210:86-91, 1987); spectinomycin (Bretagne-Sagnard et al., Transgenic Res. 5:131-137, 1996); bleomycin (Hille et al., Plant Mol. Biol. 7:171-176, 1990); sulfonamide (Guerineau et al., Plant Mol. Biol. 15:127-136, 1990); bromoxynil (Stalker et al., Science 242:419-423, 1988); glyphosate (Shaw et al., Science 233:478-481, 1986); and phosphinothricin (DeBlock et al., EMBO J. 6:2513-2518, 1987).

Other genes that could serve utility in the recovery of transgenic events but might not be required in the final product would include, but are not limited to, such examples as GUS (β-glucuronidase; Jefferson Plant Mol. Biol. Rep. 5:387, 1987), GFP and other related fluorescent proteins, and luciferase.

Plant transformation vectors comprising a disclosed isolated polynucleotide sequence are also provided. Moreover, transgenic plant cells, plant part, and plants comprising a disclosed vector construct whereby the transgenic plant has increased expression levels of one or more CAM regulatory proteins as compared to a control plant resulting in enhanced tissue succulence relative to control plants are provided.

In some embodiments, exemplary vector constructs comprises one or more such sequences under the control of a circadian promoter. In some embodiments, exemplary vector constructs further comprise one or more a gypsy barrier insulators and/or one or more unique epitope tags.

In some examples, a disclosed vector construct nucleic acid sequence shares at least 90% sequence identity, such as about 93%, 94%, 95%, 96%, 97%, 98% or 99% sequence identity to SEQ ID NOs: 15-68 and is capable of enhancing a CAM property.

In some embodiments, the method further comprises combining one or more vector constructs, such one, two, three, four, five, six, seven, eight, nine or more vector constructs into a series of complex gene circuits using the Gibson assembly approach. For example, an exemplary CAM gene circuit containing 9 CAM gene cassettes in provided in SEQ ID NO: 69.

The disclosed methods can be used to improve the drought durability of plants, such as in plants in arid environments, and also enhance the ability of plants to perform. In some examples, a disclosed method is used to increase plant cell size, leaf size, leaf number, reduce hypocotyl length, increase hypocotyl length, increase inflorescence width, increase inflorescence height, increase plant root size, increase plant root length, increase plant tissue succulence, increase plant water content, increase plant flower size, increase plant floral organ size, increase plant silique or ear size, increase fruit size, increase plant seed size, increase plant seed area, increase plant mass, increase plant seed number, increase plant total seed production; increase plant inflorescence number, or any combination thereof. In some examples, an increase is an at least 1.2 fold increase, such as at least 1.5 or an at least 2 fold increase, including between a 1.2 to 1.5 fold increase, a 1.3 to a 1.6 fold increase, a 1.2 to a 2 fold, including 1.2, 1.3, 1.4, 1.5, 1.6, 1.7, 1.8, 1.9, 2.0, 2.5, 3.0, 3.5, 4.0, 4.5 or 5 fold increase as compared to property of interest in a control plant.

In some examples, the method is used to generate a plant with improved water-use efficiency and drought tolerance. In some embodiments, a disclosed method for engineered CAM is combined with engineered tissue succulence, in order to improve the overall operational efficiency of the CAM pathway by limited the diffusion of $CO_2$ from leaf tissues during the daytime decarboxylation phases of the CAM cycle.

Plant transformation vectors comprising a disclosed isolated polynucleotide sequence are also provided. Moreover, transgenic plant cells, plant part, and plants comprising one or more disclosed vector constructs whereby the transgenic plant has increased expression levels of one or more genes involved in CAM as compared to a control plant resulting in enhanced CAM activity relative to control plants are provided.

A wide variety of transformation techniques exist in the art, and new techniques are continually becoming available. Any technique that is suitable for the target host plant can be employed within the scope of the present disclosure. For example, the constructs can be introduced in a variety of forms including, but not limited to as a strand of DNA, in a plasmid, or in an artificial chromosome. The introduction of the constructs into the target plant cells can be accomplished by a variety of techniques, including, but not limited to *Agrobacterium*-mediated transformation, electroporation, microinjection, microprojectile bombardment calcium-phosphate-DNA co-precipitation or liposome-mediated transformation of a heterologous nucleic acid construct comprising the desired coding sequence. The transformation of the plant is preferably permanent, i.e. by integration of the introduced expression constructs into the host plant genome, so that the introduced constructs are passed onto successive plant generations.

In one embodiment, binary based vector systems may be used to transfer and confirm the association between enhanced expression of an identified gene with a particular plant trait or phenotype. Standard *Agrobacterium* binary vectors are known to those of skill in the art and many are commercially available. In some examples, the binary vectors pGWB415 and pGWB402 are employed.

The optimal procedure for transformation of plants with *Agrobacterium* vectors will vary with the type of plant being transformed. Exemplary methods for *Agrobacterium*-mediated transformation include transformation of explants of hypocotyl, shoot tip, stem or leaf tissue, derived from sterile seedlings and/or plantlets. Such transformed plants may be reproduced sexually, or by cell or tissue culture. *Agrobacterium* transformation has been previously described for a large number of different types of plants and methods for such transformation may be found in the scientific literature.

Depending upon the intended use, a heterologous nucleic acid construct may be made which comprises a nucleic acid sequence, and which encodes the entire protein, or a biologically active portion thereof for transformation of plant cells and generation of transgenic plants.

B. Expression

The expression of the desired nucleic acid sequence or an ortholog, homologue, variant or fragment thereof may be carried out under the control of a constitutive, inducible or regulatable promoter. In some cases expression of a disclosed nucleic acid sequence or homologue, variant or fragment thereof may regulated in a developmental stage or tissue-associated or tissue-specific manner. Accordingly, expression of the nucleic acid coding sequences described herein may be regulated with respect to the level of expression, the tissue type(s) where expression takes place and/or developmental stage of expression leading to a wide spectrum of applications wherein the expression of a disclosed coding sequence is modulated in a plant.

Strong promoters with enhancers may result in a high level of expression.

Expression of a desired nucleic acid sequence or homologue, variant or fragment thereof may also be controlled at the level of transcription, by the use of cell type specific promoters or promoter elements in the plant expression vector.

Standard molecular and genetic tests may be performed to analyze the association between a cloned gene and an observed phenotype. A number of other techniques that are useful for determining (predicting or confirming) the function of a gene or gene product in plants are described below in the Examples.

The present disclosure describes nucleic acids encoding proteins obtained from various plant species, such as set forth in SEQ ID NOs: 1-9 or functional fragment thereof. Also provided are DNA constructs comprising the described nucleic acids. Host cells including a disclosed nucleic acid are also provided as well as methods of producing proteins from such host cells. In one embodiment, the disclosed nucleic acids confer an agronomic trait to a plant in which it is expressed, for example regulation of tissue succulence. The nucleic acids disclosed herein include recombinant DNA which is incorporated into a vector; into an autonomously replicating plasmid or virus; or into the genomic DNA of a prokaryote or eukaryote, or which exists as a separate molecule (for example, a cDNA) independent of other sequences. DNA sequences encoding desired proteins can be expressed in vitro by DNA transfer into a suitable host cell. The cell may be prokaryotic or eukaryotic. The term also includes any progeny of the subject host cell. It is understood that all progeny may not be identical to the parental cell because there may be mutations that occur during replication. Methods of stable transfer, meaning that the foreign DNA is continuously maintained in the host, are known in the art. Such host cells can be used to produce desired proteins.

DNA sequences can be manipulated with standard procedures such as restriction enzyme digestion, fill-in with DNA polymerase, deletion by exonuclease, extension by terminal deoxynucleotide transferase, ligation of synthetic or cloned DNA sequences, site-directed sequence-alteration via single-stranded bacteriophage intermediate or with the use of specific oligonucleotides in combination with PCR. A nucleic acid encoding a CEB1 can be cloned or amplified by in vitro methods, such as the polymerase chain reaction (PCR), the ligase chain reaction (LCR), the transcription-based amplification system (TAS), the self-sustained sequence replication system (3SR) and the Qβ replicase amplification system (QB). For example, a polynucleotide encoding the protein can be isolated by polymerase chain reaction of cDNA using primers based on the DNA sequence of the molecule. A wide variety of cloning and in vitro amplification methodologies are well known to persons skilled in the art. PCR methods are described in, for example, U.S. Pat. No. 4,683,195; Mullis et al., Cold Spring Harbor Symp. Quant. Biol. 51:263, 1987; and Erlich, ed., PCR Technology, (Stockton Press, N Y, 1989). Polynucleotides also can be isolated by screening genomic or cDNA libraries with probes selected from the sequences of the desired polynucleotide under stringent hybridization conditions.

Disclosed nucleic acids, such as cDNA sequences encoding proteins associated with CAM regulation, can be operatively linked to expression control sequences. An expression control sequence operatively linked to a coding sequence is ligated such that expression of the coding sequence is achieved under conditions compatible with the expression control sequences. The expression control sequences include, but are not limited to appropriate promoters, enhancers, transcription terminators, a start codon (for instance, ATG) in front of a protein-encoding gene, splicing signal for introns, maintenance of the correct reading frame of that gene to permit proper translation of mRNA, and stop codons.

Transformation of a host cell with recombinant DNA may be carried out by conventional techniques as are well known to those skilled in the art. Where the host is prokaryotic, such as $E.\ coli$, competent cells, which are capable of DNA uptake can be prepared from cells harvested after exponential growth phase and subsequently treated by the $CaCl_2$ method using procedures well known in the art. Alternatively, $MgCl_2$, or RbCl can be used. Transformation can also be performed after forming a protoplast of the host cell if desired, or by electroporation.

When the host is a eukaryote, such methods of transfection of DNA as calcium phosphate coprecipitates, conventional mechanical procedures such as microinjection, electroporation, insertion of a plasmid encased in liposomes, or virus vectors may be used. Eukaryotic cells can also be cotransformed with a second foreign DNA molecule encoding a selectable phenotype, such as the herpes simplex thymidine kinase gene. Another method is to use a eukaryotic viral vector, such as simian virus 40 (SV40) or bovine papilloma virus, to transiently infect or transform eukaryotic cells and express the protein (see for example, Eukaryotic Viral Vectors, Cold Spring Harbor Laboratory, Gluzman ed.,).

In some embodiments, inserting one or more disclosed nucleic acid sequences into the genome of a cell, such as a plant cell includes using a genome editing system, such as a CRISPR-Cas system, a TALEN system, a ZFN system, a meganuclease, and the like.

As disclosed herein, mutations in cells, such as the insertion of CEB1 nucleic acids, can be made by way of the CRISPR-Cas system or a Cas9-expressing eukaryotic cell or a Cas-9 expressing eukaryote. The Cas9-expressing eukaryotic cell or eukaryote, can have guide RNA delivered or administered thereto, whereby the RNA targets a loci and induces a desired mutation for use in or as to the invention. With respect to general information on CRISPR-Cas Systems, components thereof, and delivery of such components, including methods, materials, delivery vehicles, vectors, particles, and making and using thereof, including as to amounts and formulations, as well as Cas9-expressing eukaryotic cells, Cas-9 expressing eukaryotes, such as a mouse, reference is made to: U.S. Pat. Nos. 8,697,359, 8,771,945, 8,795,965, 8,865,406, 8,871,445, 8,889,356, 8,889,418, 8,895,308, 8,932,814, 8,945,839, 8,906,616; US Patent Publications US 2014-0310830 (U.S. application Ser. No. 14/105,031), US 2014-0287938 A1 (U.S. application Ser. No. 14/213,991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); European Patents/Patent Applications: EP 2 771 468 (EP13818570.7), EP 2 764 103 (EP13824232.6), and EP 2 784 162 (EP14170383.5); and PCT Patent Publications WO 2014/093661 (PCT/US2013/074743), WO 2014/093694 (PCT/

US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO2014/093701 (PCT/US2013/074800), WO2014/018423 (PCT/US2013/051418), WO 2014/204723 (PCT/US2014/041790), WO 2014/204724 (PCT/US2014/041800), WO 2014/204725 (PCT/US2014/041803), WO 2014/204726 (PCT/US2014/041804), WO 2014/204727 (PCT/US2014/041806), WO 2014/204728 (PCT/US2014/041808), WO 2014/204729 (PCT/US2014/041809), and vMultiplex genome engineering using CRISPR/Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15; 339(6121):819-23 (2013); RNA-guided editing of bacterial genomes using CRISPR-Cas systems. Jiang W., Bikard D., Cox D., Zhang F, Marraffini L A. Nat Biotechnol March; 31(3):233-9 (2013); One-Step Generation of Mice Carrying Mutations in Multiple Genes by CRISPR/Cas-Mediated Genome Engineering. Wang H., Yang H., Shivalila C S., Dawlaty M M., Cheng A W., Zhang F., Jaenisch R. Cell May 9; 153(4):910-8 (2013); Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. 2013 Aug. 22; 500(7463):472-6. doi: 10.1038/Nature12466. Epub 2013 Aug. 23; Double Nicking by RNA-Guided CRISPR Cas9 for Enhanced Genome Editing Specificity. Ran, F A., Hsu, PD., Lin, C Y., Gootenberg, J S., Konermann, S., Trevino, A E., Scott, D A., Inoue, A., Matoba, S., Zhang, Y., & Zhang, F. Cell August 28. pii: S0092-8674(13) 01015-5. (2013); DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013); Genome engineering using the CRISPR-Cas9 system. Ran, F A., Hsu, P D., Wright, J., Agarwala, V., Scott, D A., Zhang, F. Nature Protocols November; 8(11):2281-308. (2013); Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science December 12. (2013). [Epub ahead of print]; Crystal structure of cas9 in complex with guide RNA and target DNA. Nishimasu, H., Ran, F A., Hsu, P D., Konermann, S., Shehata, S I., Dohmae, N., Ishitani, R., Zhang, F., Nureki, O. Cell February 27. (2014). 156(5):935-49; Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S, Chen S., Jaenisch R., Zhang F., Sharp P A. Nat Biotechnol. (2014) Apr. 20. doi: 10.1038/nbt.2889; CRISPR-Cas9 Knockin Mice for Genome Editing and Cancer Modeling, Platt et al., Cell 159(2): 440-455 (2014) DOI: 10.1016/j.cell.2014.09.014; Development and Applications of CRISPR-Cas9 for Genome Engineering, Hsu et al, Cell 157, 1262-1278 (Jun. 5, 2014) (Hsu 2014); Genetic screens in human cells using the CRISPR/Cas9 system, Wang et al., Science. 2014 Jan. 3; 343(6166): 80-84. doi:10.1126/science.1246981; Rational design of highly active sgRNAs for CRISPR-Cas9-mediated gene inactivation, Doench et al., Nature Biotechnology 32(12):1262-7 (2014) published online 3 Sep. 2014; doi:10.1038/nbt.3026, each of which is incorporated herein by reference.

As disclosed herein, mutations in cells, such as the insertion of disclosed nucleic acids, can be made by way of the transcription activator-like effector nucleases (TALENs) system. Transcription activator-like effectors (TALEs) can be engineered to bind practically any desired DNA sequence. Exemplary methods of genome editing using the TALEN system can be found for example in Cermak T. Doyle E L. Christian M. Wang L. Zhang Y. Schmidt C, et al. Efficient design and assembly of custom TALEN and other TAL effector-based constructs for DNA targeting. Nucleic Acids Res. 2011; 39:e82; Zhang F. Cong L. Lodato S. Kosuri S. Church G M. Arlotta P Efficient construction of sequence-specific TAL effectors for modulating mammalian transcription. Nat Biotechnol. 2011; 29:149-153 and U.S. Pat. Nos. 8,450,471, 8,440,431 and 8,440,432, all of which are specifically incorporated by reference.

As disclosed herein, mutations in cells, such as the insertion of disclosed nucleic acids can be made by way of the zinc-finger nucleases (ZFNs) system. The ZFN system uses artificial restriction enzymes generated by fusing a zinc finger DNA-binding domain to a DNA-cleavage domain that can be engineered to target desired DNA sequences. Exemplary methods of genome editing using ZFNs can be found for example in U.S. Pat. Nos. 6,534,261, 6,607,882, 6,746,838, 6,794,136, 6,824,978, 6,866,997, 6,933,113, 6,979,539, 7,013,219, 7,030,215, 7,220,719, 7,241,573, 7,241,574, 7,585,849, 7,595,376, 6,903,185, and 6,479,626, all of which are specifically incorporated by reference.

As disclosed herein, mutations in cells, such as the insertion of a disclosed nucleic acid sequence, can be made by way of meganucleases, which are endodeoxyribonucleases characterized by a large recognition site (double-stranded DNA sequences of 12 to 40 base pairs). Exemplary method for using megonucleases can be found in U.S. Pat. Nos. 8,163,514; 8,133,697; 8,021,867; 8,119,361; 8,119,381; 8,124,369; and 8,129,134, which are specifically incorporated by reference.

The expression and purification of any of the disclosed proteins, by standard laboratory techniques, is now enabled. Fragments amplified as described herein can be cloned into standard cloning vectors and expressed in commonly used expression systems consisting of a cloning vector and a cell system in which the vector is replicated and expressed. Purified proteins may be used for functional analyses. Partial or full-length cDNA sequences, which encode for the protein, may be ligated into bacterial expression vectors. Methods for expressing large amounts of protein from a cloned gene introduced into *E. coli* may be utilized for the purification, localization and functional analysis of proteins.

Intact native protein may also be produced in *E. coli* in large amounts for functional studies. Standard prokaryotic cloning vectors may also be used, for example, pBR322, pUC18, or pUC19 as described in Sambrook et al. (Molecular Cloning: A Laboratory Manual, 2nd ed., vol. 1-3, Cold Spring Harbor, N.Y. 1989). Nucleic acids of CEB1 nucleic acids, such as cDNA sequences, may be cloned into such vectors, which may then be transformed into bacteria such as *E. coli*, which may then be cultured so as to express the protein of interest. Other prokaryotic expression systems include, for instance, the arabinose-induced pBAD expression system that allows tightly controlled regulation of expression, the IPTG-induced pRSET system that facilitates rapid purification of recombinant proteins and the IPTG-induced pSE402 system that has been constructed for optimal translation of eukaryotic genes. These three systems are available commercially from INVITROGEN™ and, when used according to the manufacturer's instructions, allow routine expression and purification of proteins.

Methods and plasmid vectors for producing fusion proteins and intact native proteins in bacteria are described in Sambrook et al. (Molecular Cloning: A Laboratory Manual, Cold Spring Harbor, N.Y., 1989, Chapter 17). Such fusion proteins may be made in large amounts and are easy to purify. Proteins can be produced in bacteria by placing a strong, regulated promoter and an efficient ribosome binding site upstream of the cloned gene. If low levels of protein are produced, additional steps may be taken to increase protein production; if high levels of protein are produced, purification is relatively easy. Suitable methods are presented in Sambrook et al. (Molecular Cloning: A Laboratory Manual, Cold Spring Harbor, N.Y., 1989) and are well known in the art. Often, proteins expressed at high levels are found in insoluble inclusion bodies. Methods for extracting proteins from these aggregates are described by Sambrook et al. (Molecular Cloning: A Laboratory Manual, Cold Spring Harbor, N.Y., 1989, Chapter 17).

A number of viral vectors have been constructed, that can be used to express the disclosed sequences, including polyoma, i.e., SV40 (Madzak et al., 1992, J. Gen. Virol., 73:15331536), adenovirus (Berkner, 1992, Cur. Top. Microbiol. Immunol., 158:39-6; Berliner et al., 1988, Bio Techniques, 6:616-629; Gorziglia et al., 1992, J. Virol., 66:4407-4412; Quantin et al., 1992, Proc. Natl. Acad. Sci. USA, 89:2581-2584; Rosenfeld et al., 1992, Cell, 68:143-155; Wilkinson et al., 1992, Nucl. Acids Res., 20:2233-2239; Stratford-Perricaudet et al., 1990, Hum. Gene Ther., 1:241-256), vaccinia virus (Mackett et al., 1992, Biotechnology, 24:495-499), adeno-associated virus (Muzyczka, 1992, Curr. Top. Microbiol. Immunol., 158:91-123; On et al., 1990, Gene, 89:279-282), herpes viruses including HSV and EBV (Margolskee, 1992, Curr. Top. Microbiol. Immunol., 158:67-90; Johnson et al., 1992, J. Virol., 66:29522965; Fink et al., 1992, Hum. Gene Ther. 3:11-19; Breakfield et al., 1987, Mol. Neurobiol., 1:337-371; Fresse et al., 1990, Biochem. Pharmacol., 40:2189-2199), Sindbis viruses (H. Herweijer et al., 1995, Human Gene Therapy 6:1161-1167; U.S. Pat. Nos. 5,091,309 and 5,2217,879), alphaviruses (S. Schlesinger, 1993, Trends Biotechnol. 11:18-22; I. Frolov et al., 1996, Proc. Natl. Acad. Sci. USA 93:11371-11377) and retroviruses of avian (Brandyopadhyay et al., 1984, Mol. Cell. Biol., 4:749-754; Petropouplos et al., 1992, J. Virol., 66:3391-3397), murine (Miller, 1992, Curr. Top. Microbiol. Immunol., 158:1-24; Miller et al., 1985, Mol. Cell. Biol., 5:431-437; Sorge et al., 1984, Mol. Cell. Biol., 4:1730-1737; Mann et al., 1985, J. Virol., 54:401-407), and human origin (Page et al., 1990, J. Virol., 64:5370-5276; Buchschalcher et al., 1992, J. Virol., 66:2731-2739). Baculovirus (*Autographa californica* multinuclear polyhedrosis virus; AcMNPV) vectors are also known in the art, and may be obtained from commercial sources (such as PharMingen, San Diego, Calif.; Protein Sciences Corp., Meriden, Conn.; Stratagene, La Jolla, Calif.).

Various yeast strains and yeast-derived vectors are commonly used for expressing and purifying proteins, for example, *Pichia pastoris* expression systems are available from INVITROGEN™ (Carlsbad, Calif.). Such systems include suitable *Pichia pastoris* strains, vectors, reagents, transformants, sequencing primers and media. Non-yeast eukaryotic vectors can also be used for expression, such as mMTPSL 1, 2 and 4 through 48 polypeptides. Examples of such systems are the Baculovirus system, the Ecdysone-inducible mammalian expression system that uses regulatory elements from *Drosophila melanogaster* to allow control of gene expression, and the Sindbis viral expression system that allows high level expression in a variety of mammalian cell lines. These expression systems are available from INVITROGEN™.

In addition, some vectors contain selectable markers such as the gpt (Mulligan and Berg, Proc. Natl. Acad. Sci. USA 78:2072-6, 1981) or neo (Southern and Berg, J. Mol. Appl. Genet. 1:327-41, 1982) bacterial genes. These selectable markers permit selection of transfected cells that exhibit stable, long-term expression of the vectors (and therefore the cDNA). The vectors can be maintained in the cells as episomal, freely replicating entities by using regulatory elements of viruses such as papilloma (Sarver et al., Mol. Cell. Biol. 1:486, 1981) or Epstein-Barr (Sugden et al., Mol. Cell. Biol. 5:410, 1985). Alternatively, one can also produce cell lines that have integrated the vector into genomic DNA. Both of these types of cell lines produce the gene product on a continuous basis. One can also produce cell lines that have amplified the number of copies of the vector (and therefore of the cDNA as well) to create cell lines that can produce high levels of the gene product (Alt et al., J. Biol. Chem. 253:1357, 1978).

The transfer of DNA into eukaryotic cells is now a conventional technique. The vectors are introduced into the recipient cells as pure DNA (transfection) by, for example, precipitation with calcium phosphate (Graham and vander Eb, 1973, Virology 52:466) or strontium phosphate (Brash et al., Mol. Cell. Biol. 7:2013, 1987), electroporation (Neumann et al., EMBO J. 1:841, 1982), lipofection (Felgner et al., Proc. Natl. Acad. Sci. USA 84:7413, 1987), DEAE dextran (McCuthan et al., J. Natl. Cancer Inst. 41:351, 1968), microinjection (Mueller et al., Cell 15:579, 1978), protoplast fusion (Schather, Proc. Natl. Acad. Sci. USA 77:2163-7, 1980), or pellet guns (Klein et al, Nature 327:70, 1987). Alternatively, the cDNA can be introduced by infection with virus vectors. Systems are developed that use, for example, retroviruses (Bernstein et al., Gen. Engrg. 7:235, 1985), adenoviruses (Ahmad et al., J. Virol. 57:267, 1986), or Herpes virus (Spaete et al., Cell 30:295, 1982).

C. Transgenics

Also provided are transgenic plants. In one embodiment, a transgenic plant is stably transformed with a disclosed nucleic acid construct, such as a construct comprising one or more disclosed nucleic acid sequences. In some embodiments, the transgenic plant is a dicotyledon. In other embodiments, the transgenic plant is a monocotyledon. Further provided is a seed of a disclosed transgenic plant. In one embodiment, the seed comprises the disclosed nucleic acid construct. Even further provided is a transgenic plant cell or tissue. In one embodiment, a transgenic plant cell or tissue comprises a disclosed nucleic acid or functional fragment thereof. In some embodiments, the plant cell or tissue is derived from a dicotyledon. In other embodiments, the plant cell or tissue is from a monocotyledon.

Also provided are methods of producing a disclosed transgenic plant, plant cell, seed or tissue. In some embodiments, the method comprises transforming a plant cell or tissue with a disclosed nucleic acid construct.

Further provided are a plant cell, fruit, leaf, root, shoot, flower, seed, cutting and other reproductive material useful in sexual or asexual propagation, progeny plants inclusive of F1 hybrids, male-sterile plants and all other plants and plant products derivable from the disclosed transgenic plants.

In some embodiments, an expression cassette including a disclosed a nucleic acid sequence (such as having at least 80% sequence identity to the nucleic acid sequence set forth by one of the disclosed sequences or a degenerate nucleic acid) or functional fragment thereof, operably linked to promoter and optionally other heterologous nucleic acids can be used to transform any plant or part thereof, such as a plant cell, for example as a vector, such as a plasmid. In this manner, genetically modified plants, plant cells, plant tissue, seed, and the like can be obtained. Such methods, include introducing into a plant a nucleic acid sequence (such as having at least 80% sequence identity to the nucleic acid sequence set forth herein or a degenerate nucleic acid) or functional fragment thereof, operably linked to promoter and optionally other heterologous nucleic acids. The plant can be transiently or stably transformed. Tissue succulence can be determined relative to a relevant control plant. The control plant is generally matched for species, variety, age, and the like and is subjected to the same growing conditions, for example temperature, soil, sunlight, pH, water, and the like. The selection of a suitable control plant is routine for those skilled in the art.

Transformation protocols as well as protocols for introducing nucleotide sequences into plants may vary depending on the type of plant or plant cell, for example, monocot or dicot, targeted for transformation. Suitable methods of introducing nucleotide sequences into plant cells and subsequent insertion into the plant genome include microinjection (Crossway et al., Biotechniques 4:320-334, 1986), electroporation (Riggs et al., Proc. Natl. Acad. Sci. USA 53:5602-5606, 1986), Agrobacterium-mediated transformation (U.S. Pat. No. 5,563,055), direct gene transfer (Paszkowski et al., EMBO J. 3:2717-2722, 1984), and Biolistic® particle acceleration (see, for example, U.S. Pat. No. 4,945,050; Tomes et al. "Direct DNA Transfer into Intact Plant Cells via Microprojectile Bombardment," in Plant Cell, Tissue, and Organ Culture: Fundamental Methods, ed. Gamborg and Phillips (Springer-Verlag, Berlin), 1995; and McCabe et al., Biotechnology 5:923-926, 1988). Also see Weissinger et al., Ann. Rev. Genet. 22:421-477, 1988; Sanford et al., Paniculate Science and Technology 5:27-37, 1987; Christou et al., Plant Physiol 57:671-674, 1988; McCabe et al., Bio/Technology 5:923-926, 1988; Finer and McMullen, In Vitro Cell Dev. Biol. 27P:175-182, 1991; Singh et al., Theor. Appl Genet. 95:319-324, 1998; Datta et al., Biotechnology 5:736-740, 1990; Klein et al., Proc. Natl. Acad. Sci. USA 55:4305-4309, 1988; Klein et al., Biotechnology 5:559-563, 1988; U.S. Pat. Nos. 5,240,855, 5,322, 783 and 5,324,646; Klein et al., Plant Physiol 97:440-444, 1988; Fromm et al. Biotechnology 5:833-839, 1990; Hooykaas-Van Slogteren et al., Nature 377:763-764, 1984; Bytebier et al., Proc. Natl. Acad. Sci. USA 54:5345-5349, 1987; De Wet et al. (1985) in The Experimental Manipulation of Ovule Tissues, ed. Chapman et al. (Longman, N.Y.), pp. 197-209; Kaeppler et al., Plant Cell Reports 9:415-418, 1990; Kaeppler et al., Theor. Appl. Genet. 54:560-566, 1992; D'Halluin et al., Plant Cell 4:1495-1505 1992; Li et al., Plant Cell Reports 72:250-255, 1993; Christou and Ford Annals of Botany 75:407-413, 1995; Osjoda et al., Nature Biotechnology 74:745-750, 1996; and the like. "Introducing" in the context of a plant cell, plant tissue, plant part and/or plant means contacting a nucleic acid molecule with the plant cell, plant tissue, plant part, and/or plant in such a manner that the nucleic acid molecule gains access to the interior of the plant cell or a cell of the plant tissue, plant part or plant. Where more than one nucleic acid molecule is to be introduced, these nucleic acid molecules can be assembled as part of a single polynucleotide or nucleic acid construct, or as separate polynucleotide or nucleic acid constructs, and can be located on the same or different nucleic acid constructs. Accordingly, these polynucleotides can be introduced into plant cells in a single transformation event, in separate transformation events, or, for example as part of a breeding protocol.

The cells that have been transformed can be grown into plants in accordance with conventional ways. See, for example, McCormick et al. Plant Cell Reports 5:81-84, 1986. These plants may then be grown, and either pollinated with the same transformed strain or different strains, and the resulting hybrid having expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved.

In some embodiments, a nucleic acid sequences disclosed herein, such as a nucleic acid sequence having at least 80% sequence identity to the nucleic acid sequence set forth by one of SEQ ID NOs: 1-9 or a degenerate nucleic acid or active variant and fragments thereof are used for transformation of any plant species, including, but not limited to, monocots and dicots. Examples of plant species of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (Citrus spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers. Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the present invention include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*), and various Poplar and *Eucalyptus* species.

In specific embodiments, plants of the present disclosure are crop plants (for example, corn, alfalfa, sunflower, *Brassica*, soybean, cotton, safflower, peanut, sorghum, wheat, millet, tobacco, etc.). In other embodiments, corn and soybean plants are optimal, and in yet other embodiments soybean plants are optimal. Other plants of interest include grain plants that provide seeds of interest, oilseed plants, and leguminous plants. Seeds of interest include grain seeds, such as corn, wheat, barley, rice, sorghum, rye, etc. Oil-seed plants include cotton, soybean, safflower, sunflower, *Brassica*, maize, alfalfa, palm, coconut, etc. Leguminous plants include beans and peas. Beans include guar, locust bean, fenugreek, soybean, garden beans, cowpea, mungbean, lima bean, fava bean, lentils, chickpea, etc.

In some embodiments, the disclosed polynucleotides are engineered into a molecular stack. Thus, the various plants, plant cells and seeds disclosed herein can further comprise one or more traits of interest, and in more specific embodiments, the plant, plant part or plant cell is stacked with any combination of polynucleotide sequences of interest in order to create plants with a desired combination of traits. As used herein, the term "stacked" includes having the multiple traits present in the same plant. These stacked combinations can be created by any method including, but not limited to, breeding plants by any conventional methodology, or genetic transformation. If the sequences are stacked by genetically transforming the plants, the polynucleotide sequences of interest can be combined at any time and in any order. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO99/25821, WO99/25854, WO99/25840, WO99/25855, and WO99/25853.

The transformed plants may be analyzed for the presence of the gene(s) of interest and the expression level. Numerous methods are available to those of ordinary skill in the art for the analysis of transformed plants. For example, methods for plant analysis include Southern and northern blot analysis, PCR-based (or other nucleic acid amplification-based) approaches, biochemical analyses, phenotypic screening methods, field evaluations, and immunodiagnostic assays (e.g., for the detection, localization, and/or quantification of proteins).

The following examples are provided to better describe the present disclosure and to guide those of ordinary skill in the art in the practice of the present disclosure.

EXAMPLES

Example 1

Material and Methods

Expression analysis of core CAM genes in ice plant

Seedlings of the wild-type ice plant (*Mesembryanthemum crystallinum* L.) were grown in a growth chamber under 12 h/12 h (light, 350 µmol $m^{-2}$ $s^{-1}$/dark) cycles at 26° C./18° C. (day/night). Four-week-old plants were subjected to well-watered and water-deficit stressed conditions for seven days and leaves were collected at each time point 0 (dawn), 4, 8, 12 (dusk), 16, 20, and 24 h (dawn). Total RNA was isolated using the RNeasy Midi Kit with a modified PEG-RNA extraction method that utilizes high-molecular weight polyethylene glycol (Gehrig et al, 2000, Plant Molecular Biology Reporter 18: 369-376). The cDNA library was sequenced on a single read flow cell using the illumina HiSeq2000 system. RNA-seq data were assembled and then the relative mRNA expression values were normalized by TMM (trimmed mean of M-values). The averaged FPKM (fragments per kb of exon per million fragments mapped) values of three replicates were then calculated (Robinson and Oshlack, 2010, Genome Biology 11 (R25); Trapnell et al., 2010, Nature Biotechnology 28: 511-515). Examination of the expression values allowed for the identification of specific isogenes encoding key $C_4$ enzymes that are involved in the crassulacean acid metabolism (CAM) pathway.

CAM Gene Cloning

To isolate nine selected CAM genes in ice plant, the full-length coding sequences of McBca2 (encoding beta-carbonic anhydrase), McPpc1 (encoding phosphoenolpyruvate carboxylase), McPpck (encoding phosphoenolpyruvate carboxylase kinase), McMdh2 (NAD-malate dehydrogenase), McNADP-ME3 (NADP-malic enzyme), McPpdk1 (encoding pyruvate orthophosphate dikinase), McPpdk-RP (encoding pyruvate orthophosphate dikinase regulatory protein), McALMT4 (vacuolar aluminum malate transporter), and MctDT (tonoplast-dicarboxylate transporter), were retrieved from transcriptome assembly as described above. First-strand complementary DNA (cDNA) synthesis from 500 ng of total RNA at indicate time points (unstressed condition; 24 h, drought stress condition; 04, 08, 12, and 24 h) was performed using a SuperScript® III kit (Invitrogen, Carlsbad, Calif., USA) according to the manufacturer's protocol. The nine CAM genes were amplified with appropriate primer pairs (Tables 1 and 2) using a high-fidelity pfu Turbo DNA polymerase (Stratagene, La Jolla, Calif., USA) from the cDNA mixture. Purified PCR products then were directly introduced into the Zero Blunt® TOPO vector (Invitrogen, Carlsbad, Calif., USA). Each of the cloned coding sequences was verified by DNA sequencing (Nevada Genomics Center, Reno, Nev., USA) and subcloned into pENTR™ D-TOPO vector (Invitrogen, Carlsbad, Calif., USA) containing attachment L1 and L2 sites for gateway LR reaction. SEQ ID Nos: 70-78 provide sequences for Zero Blunt TOPO vectors including DNA sequences of CAM-gene coding regions.

Promoter Mining in *Arabidopsis*

In order to retrieve circadian clock-controlled genes in *Arabidopsis*, high-throughput experimental data of mRNA expression profiling were collected from the public repository of Gene Expression Omnibus (GEO). Three microarray datasets of Hsu and Harmer (2012, PLoS ONE 7: e49853), Covington and Harmer (2007, PLoS Biology 5: e222), and Edwards et al. (2006, Plant Cell 18: 639-650) were chosen for the analysis of circadian clock-controlled genes. Then, quantile normalization was carried out using commercial software, CLC Main Workbench. After cross-platform mapping, a total of 20,221 genes were retrieved and matched to the TAIR 10 database for annotation (see World Wide Web address *arabidopsis*.org/). Next, circadian clock-controlled genes were identified and analyzed using the JTK-Cycle algorithm (Hughes et al., 2010, Journal of Biological Rhythms 25: 372-380) for robust circadian rhythms ($p<0.05$). A total of 982 genes were retrieved that were common among three datasets. Then, the tissue-specific expression patterns and mesophyll versus guard cell expression patterns of 982 genes were verified manually by comparison to the on-line *Arabidopsis* eFP Browser (Winter et al., 2007, PLoS ONE 2: e718). In the final analysis, 14 genes with circadian rhythmic and mesophyll-specific expression patterns were used to provide optimal expression of the core ice plant CAM genes in *Arabidopsis*.

Plasmid Construction and Cloning for Promoter Analysis

To identify tissue-specific- and/or circadian rhythmic expression patterns of upstream regions of the selected 14 genes in *Arabidopsis*, a GUS/LUC dual vector was constructed by fusing the full coding sequence (CDS) of firefly luciferase (LUC) to bacterial β-glucuronidase (GUS). An ASGGGA (SEQ ID NO: 211) flexible linker was incorporated between the GUS and LUC to minimize the loss of enzymatic activities and to limit conformation interference in the GUS/LUC fusion protein. The synthesized HindIII-attR1-chloramphenicol acetyl transferase (CAT)-ccdB-GUS-ASGGGA (SEQ ID NO: 211)-LUC-attR2-SacI (5,255 bp) genes were cloned into pGWB401 (Nakagawa et al., 2007, Bioscience Biotechnology, and Biochemistry 71: 2095-2100), then named the GUS/LUC dual vector. The DNA sequence of the GUS/LUC dual vector is presented as SEQ ID NO: 79.

Putative promoter regions (up to 1.5 kb of sequence upstream of the translation start site) of selected 14 genes, AT3G59350pro1 (5'-upstream region; −1114 to +245, protein kinase protein), AT4G32340pro2 (−878 to +86, tetratricopeptide repeat-like protein), AT5G23240pro3 (−1310 to +190, DNAJ heat shock N-terminal domain-containing protein), AT5G44050pro4 (−903 to −1, MATE efflux family protein), AT4G04330pro5 (−1466 to +34, chaperonin-like RbcX protein), AT4G23290pro6 (−1105 to +16, cysteine-rich RLK 21), AT1G07180pro7 (−1406 to +94, alternative NADPH dehydrogenase 1), AT1G65490pro8 (−1479 to +21, unknown protein), AT1G21670pro9 (−1332 to +11, unknown protein), AT2G17450pro10 (−1397 to +103, RING-H2 finger A3A), AT4G01130pro11 (−1349 to +35, GDSL-like lipase/acylhydrolase protein), AT5G19240pro12 (−1420 to +80, glycoprotein membrane precursor GPI-anchored), AT5G58120pro13 (−852 to −1, disease resistance protein), and AT3G47340pro14 (−1300 to +200, glutamine-dependent asparagine synthase 1) with attL1 and attL2 were synthesized by DNA 2.0 and cloned into the GUS/LUC dual vector using LR clonase (Invitrogen, Carlsbad, Calif., USA).

Gene Synthesis of Terminator and Protein Tag

Putative terminator regions (up to 873 bp of downstream sequences from the stop codon) of selected 14 genes, AT3G59350ter1 (3'-downstream region; +2199 to +2629), AT4G32340ter2 (+1566 to +2438), AT5G23240ter3 (+1869 to +2113), AT5G44050ter4 (+3727 to +4226), AT4G04330ter5 (+1899 to +2072), AT4G23290ter6 (+2918 to +3417), AT1G07180ter7 (+2455 to +2954), AT1G65490ter8 (+406 to +905), AT1G21670ter9 (+2124 to +2607), AT2G17450ter10 (+662 to +1161), AT4G01130ter11 (+2176 to +2675), AT5G19240ter12 (+854 to +1353), AT5G58120ter13 (+3437 to +3698), and AT3G47340ter14 (+3109 to +3608), were synthesized with attL3 and attL2. For evaluation of the protein expression levels of the CAM genes in transgenic plants, the 3×FLAG, V5, 3×HA, 4×cMyc, AU1, AcV5, Strep-tagII, 6×His, and T7 protein tag were codon optimized based upon the Codon Usage Database (see website kaxusa.or.jp/codon/) in *Arabidopsis* and synthesized with attR4 and R3 recombination sites. All synthesized DNA sequences of putative the promoters, terminators, and protein tags are presented below (bold letters indicate attachment sites for Multisite Gateway cloning; italic letters are additional sequences for adjusting protein frame; promoter, terminator, or protein tag are in upper case no italic or bold; and lower case letters in protein tag sequences, are codon optimized sequences):

```
AT3G59350pro1 (5'- upstream region; -1114 to +245; SEQ ID NO: 80)
CAAATAATGATTTTATTTTGACTGATAGTGACCTGTTCGTTGCAACAAA

TTGATAAGCAATGCTTTTTTATAATGCCAACTTTGTACAAAAAAGCAGG

CTGATTTCTATCAATGAAAGTAGACGTTAAAAAAAAAAAAAGATATCACA

GTACGTGGAAACACGTGACACATATTTTAAAGGGAAAATATAAACGTGAA

ATGCGTGGAAACTGGCAAGTAGACTATTAATATTTATGGGCCTATAGTGGT

TATATCAGGCTTTATTGGGCTCTCTATACGAATTAAAAGCCTCAAACAAATA

ATAGAACTTGAATTGTAGGCTTTTGTACCCACCAAACTGGCCGCCGGTGAC

CCCCTCTCACGCCGTATCTCTTTTTCTTTTTCTTGTTTTTTTTTTTTTTTTTTT

TTTTTTTTTTTTGTGTGCGCGTATTTGTTTCACCATCAAAAAATTAATTTTG

TTTTAAGTGTTTTATTTTCCTTCGTTTTGTTTAAAGTGTTTAAAATCGTTAGT

TCAATGTTGAAAAATATACAATAATAGAAACAATTGTGACTTTTGTAATTTG

AATGAACAAAACATATAACAATAAGTCCTATAATATAAACATTTTAATTTA

CATTTTCAACTTTTTCTCATTTTAAATTTTTATTCAGTTGAAGGCTTGAAGCG

TTGGACTACTTTAGAGAAACTTTACAAGAACGTTCTTAACATCTTTTTTTCTT

TCCTTTTTGAATATCAAAATCAGTTAAAAACACTTTTGATCTCACAGAAACT

GATACAAAGCCGACGGAACCGACCAGATTAGGTCAAAAACGTAAAAGACG

CGCAAAAAGAAAAGAAAATAACTCATAATAGAATGTTTTAGTCAGAAGAA

AAAAGTACAATATGACCAACGTAAACAAAAAAGATGTTGACGACATAAAG
```

-continued

AAAAGAGCTACAGAGACAAAGGCATTAAAATATCTTTTGTCGAAATCTGAA

GATATTTCCTTAAGCGCGTTTGCTTCTCTGTCTCCTCCATTCCATTCTATATC

ATCTCTGTCTTTGCTCTAAGCTTTCCTGTCAAAACAAAAATTCAATTCCCCA

CGTCTGTCTTATCCACAATAAAACCGACCTTAGCTTAGCTTAGACTCATTAC

TCATTTCACAAAAACAGAGAGAGAAATAGAGAGACATACTTTACAGGTAAT

AATTATCTTGTTTAATTGTATTATATATCTCAACTAAATTTGGGATAAAAA

TTGTCTATTCTTGATCATTCCTCTCTGTATCTCTCTGCTTTTGACACCTTCTCT

TAGCTGTTTTTTCATCTTTTATCTCTGTTTTTAAAATCTTTTGGCTCTTTCGAA

GGGTTTCGAGTCCTTTTGAGTTCTTTGGGCTTCCTCCCAAATTTCTCCACGA

GCTCGACCCCTTTCGTATCTTCCTTCTCATTTTTTTGCCAAATTTATTCGATC

CGTCTTTCACTACCCAGCTTTCTTGTACAAAGTTGGCATTATAAGAAAGC

ATTGCTTATCAATTTGTTGCAACGAACAGGTCACTATCAGTCAAAATAA

AATCATTATTTG

AT4G32340pro2 (-878 to +86; SEQ ID NO: 81)
CAAATAATGATTTTATTTTGACTGATAGTGACCTGTTCGTTGCAACAAA

TTGATAAGCAATGCTTTTTATAATGCCAACTTTGTACAAAAAAGCAGG

CTTTCATTAAAAAATATTTTTATACTATATAAAGAAAGCAGAAAAACACA

GTTTAATTGCTTTTTTCAAGTTCCATATCATTTTTAGTGTATATTTATTGCCC

TTTTATAAATGAAATTAGGAAATTTGGATCACCTTATGGTCAATTTCTTTAT

TTTTTTAGTTATACCACATTTATACTACTGATGATGAAAATCGATTTTTTGTA

TCGTGAACACTTATTAACTGGTTTTATCTTGAATAATAAAACTTCCATAGTT

ATTCCGTTATTGTTAGGTCATTGTAAAAAATCATCAGCAATTAGTCATTAAA

TATACTATCAAAGCTTGTCAGTCATTTCTCATCAATTCTAGCAAAATTATTC

GATATATCCAAATCCAAATGTCTTGGTTTGGTCATGACTCATGACCGTGGAA

ATAAGTTCAAGAATGCAAAAGTAACTTATTTGTGGGACAGAATCAAATTC

TTTGATCCAGTTACTTACGTCTTTCCGTAGCCAATCAAATTGAAATATTTTCT

TTAGGGGTATTCGATTATGGTGGTCCTGAAGCCTATAACAATTGTTTTCCGA

TAAGATTTGATATATATAAATAAGGGAACAATCCCCAAAAATGATATCTAG

TTAAGATAGTCGTAGAATTTACAGAAAAGGCTACTTATGTTTTTGGCCTGAT

AATGCAAATACTTTCAAAATGTTTTATTTGCTAACTAGCTTTTAGTTTCGTTC

TCGTATCTAAAGTTAGAGATTAACTTACTATTCTTGTATTACGATAACGTTT

TGAATGAACATGTAATGATGCAAGGGTGTAACCAAAAATGATAAAACTTTG

GGGTCAATTTGATAATATTGACTAATAGTGTGGGCTTGACAAGAACCGGA

AACTCCATGATATTTTTGCAGTCTAAATATCTTTTCATCTCTCTTCTCTTCCT

CCACTGAAATATTCCCCACAAGAACTAACAACCCAGCTTTCTTGTACAAA

GTTGGCATTATAAGAAAGCATTGCTTATCAATTTGTTGCAACGAACAGG

TCACTATCAGTCAAAATAAAATCATTATTTG

AT5G23240pro3 (-1310 to +190; SEQ ID NO: 82)
CAAATAATGATTTTATTTTGACTGATAGTGACCTGTTCGTTGCAACAAA

TTGATAAGCAATGCTTTTTATAATGCCAACTTTGTACAAAAAAGCAGG

CTCTGAAATTTAGTAGAGAAAAATATATGTTTTTTTCTACATACAGAATAGT

TTGAATTTTTAAAATCGGATTTGAATTTTAAAAATAGAAATAGTGTTTGTAA

-continued

GTAAAAAATATATTGTACTATTTAAGATGTATAGAAATAAAATATTGTTCTA

TACTATTTTCATAACTGATTTGTAAATCAATTTTAATTTTAGTATAGAGCAA

AATGTTTTAAATATAAAGTAATAGTGTTGGTAGTGGTGATGAGATAGTAGT

TTATGTTACGTTAATATAGCATTATAATCAATTAAATGTTTTGTTGGAAGG

ATACTAAACCCTAAGTGGATAATATATTGGGAACCCAAAGATTTCAATCTA

AAATTTAATATTCTTTAACCATAGAAAAATAGAATAATATATGTTTGTCATC

ACTACCAACATAACGAGTAGCACAGCACAAGATAGTCTCTTGGTAGAGGA

AAGAAGTGGTAGTAGAGAACACCGGGTACACCATTTGGGTTCCACAATCGA

GGGCACAAGGAGACACGAACTCGCCACACTTAACTAGAAATTGATGTAACT

CCAAAAAAATCCAAAATTTTACCTTTGTAAATCAAAACCCCCAATTCAATTT

AATCACAAACCCTAGACGTCAATTCCAAAAATTAAATGTATTGATTCCGTC

GCCAATACATCTCCATTGAACGTTTTCAGAATCCGAAGCTTTACAAAAAGG

AGATAGTAATTTTTGGGACCCAAAAAGCTGTTGGAATGTTAACAGCTGATG

AGAAAGTGTTTTTTGGAAAGAGAGAAGAAGAAGAAGAAAAAGAGCCTGTA

TCTCAGGCAAAGGGTAGCATTGTCATTATTACAGAAAATACAAATAATATC

AGTATCTTTTTGTGGGATGGTTAGTTACTTAATTATAATTTTTTTGTAGATTA

AAAACTCAAATTTCTCAAAATTATACTCTCCTAAGTAGAAAAATTTTACAA

GTTTGATTTCTTGAAAATTGATATTATAATTTATTTTTCTGATTAGGGTGGG

AAGATTCTTTATAATTTTTTTGGTTTACCTGAAAATGAAAGAAAAGATTGTA

AGAAAGATACAACAAGTGTAGACTGGATCTTTTAAAGTCCAAACCAAAAGC

CAAAAATTAGGTAACCTAAATATGTAAGACTTTATTTTTTGGTTTTTCTTATT

AAAACAACATTTCGATAATTCATTATGATATTTTTTACGCTATGATCCTCAG

CCTTAAACTTTCATTCGTATAGAAGGATAATATCATAATAGTACAACTCTTT

TAATTGCCACCAATCAACTTTATTGTCTGCTTTCAAAAATTTTATTTTTTATA

AAATATTATTCATTTTAGCTATAACTCAATTTGGAACTTTTATTCGTCCCAA

ATAAAATATCTTTCCAAGAGAGATGGAAAAATAGCTTCATATAGAGATATT

TTCAACAACTTGTCCCTCTCTAAACTCATCCACCTTCCAAAACAGAGAAGG

GGAAAATACCCAGCTTTCTTGTACAAAGTTGGCATTATAAGAAAGCATT

GCTTATCAATTTGTTGCAACGAACAGGTCACTATCAGTCAAAATAAAAT

CATTATTTG

AT5G44050pro4 (-903 to -1; SEQ ID NO: 83)
CAAATAATGATTTTATTTTGACTGATAGTGACCTGTTCGTTGCAACAAA

TTGATAAGCAATGCTTTTTTATAATGCCAACTTTGTACAAAAAAGCAGG

CTCTCTTTCTAATTTCAGGTTATAATTTATTAATTTTGGCGGAGTAAAAGTA

GATGACCGTTACAAGTCTGATTTATTAGACTGTGAAATTGGACCGTTGTTAT

GTGGGCCATGGCTTTTATTAAAAAAAGAAGAGAAGGTATATTATTTAAATT

GGAGATAATGGGCCGTTTTAAACCCAATTATTATTGGTCCACTAAAGTTTTT

ATATCCTCTAACTTCGACGAGCTTGATATAGTTTTGGACCTTTTGGTGTGAA

CGGTCACATTCAACTAAATTAAAAAGTCCAACAAACAAATCTGGTCATGA

AAAGCTTGGTGTGATGTTTCTAATAAGTAAATTTACTGAGGTTAATTGGTTG

GTTTAACTTAAATGTAATCCAAACTCCTCTCCCTTTAGAGATTTTCAGTTGG

-continued
```
GAATGAAAACCTTTAAAGCTTGCACCCTAAAATGACATTAATGGTTATAGA

TATAGTTTGTTTTCATGTTTCTTTTTTTTTATATTTTCCTTTAGTTTTTTCTAG

GGTTGGGACTAAATAATCGGACTCGGATCCGAGATCCGATTTGAAAAGCTG

GATACCCAATTGGGATGGATCCGCTTCCGGATCCTGAATTTTTAGATTCAGA

TGAATATTTTTTTTAAACTAAAGAAAGCATATCAGCATCACATTTTTGTGG

TGATACTGCTTCAAGAATCTGTCACATATCTGTCCAAAAGAAAAGAATTTG

TCACATATTGTATAATTTTAATATATTTATTGTTTTAGTTTGAAAACAAACG

TGGAAAAAAACATCTTACAGGTGTCAGGTGTGCCGCGTCGTCCCACTCAAA

GCCTATATCATCAATTTTCTGGCTGTTCTAATCTACTCAATTTATTTTTTAT

TGTTAATTTACTGAAGATCGGCGACCCAGCTTTCTTGTACAAAGTTGGCA

TTATAAGAAAGCATTGCTTATCAATTTGTTGCAACGAACAGGTCACTAT

CAGTCAAAATAAAATCATTATTTG
```

AT4G04330pro5 (-1466 to +34; SEQ ID NO: 84)
```
CAAATAATGATTTTATTTTGACTGATAGTGACCTGTTCGTTGCAACAAA

TTGATAAGCAATGCTTTTTTATAATGCCAACTTTGTACAAAAAAGCAGG

CTTTTTAAATATCTGTATTTTGCCTCCTTTTCATTCTATTTTGTTTGATACAA

ACGATTGTGGTTTGTAATGTTAAAATTAGGAATGTTATTGAATGATATGTAT

ATTTCATAAAAATAATAATAATAAAAGTAGGATGAATAGTAAAATTCCAAG

GCATTTCATAATTTACCCATTACATGGTCAAAATTTATCAATATTTTAAAAT

AATAATAATCATCCAATCAAGATTTTGGGAATAGAATATCTTAAGAACTTA

GTATAATTACATATATATATATATATTCCCTTTTAAATGTATCAAAAACAAA

CTAAGAACATACAAGGAATTTGATGTAGTACTATACAATTTACATGCAAAC

AGATGTAGTACTATTTGATGACAAAAAAAAAAAAAAGATGTAGTACTATT

TTATCTTTTCATCGGAATAATTCGGTCATGAAGCTATTAATTGGTTTTAATG

AGAATTTATTATAACAGTTGTTGCCACACTGTCGAAATACTAACGCCTAAC

GGCTAGTTAAATAATTAACACGCGGTGAGAAGTGAGTGAGTTACACGAACC

ACTAAGAATCTAATATAGGAAGATAAGATAAGCATTTCACACGTGTGGTGT

GGACAATTTAACAGTGTTAACACGCGCATGGCATGTGATCTAGAAATTAGA

ACATTAATTTTAGCGTTTTGACTTTGACCTTTGAATCACTAGGCGTAGGTAT

TTACACGTGTAACAATATAATTTTTTTCAATATGTGATGATCATGGGCCAAC

GTTTGTGGGTAAAGGTGTGGTGTTCGATCATGATCCACTTAAATTTACTGAA

TTTTAGAATTATAACAGCAGAAGGATATAAGTAATATACCAAACTTAACTA

TAATCTACCTCTCCTTGTCTATGTATACTAAATGTCTAACATGTAACACAAA

GCTGTACAAAATTTTTAACTCTCAAATTTTTTGAAATAATGCAAAGCTGTAA

AAATAGCTGTACGAGAAAACTGTACAATAAAACTGAAAATAAAAAAATTT

GTAACGTTTTTGATAAAAGTTTTGTAAATGTATAACCATCAAAACTGTACAA

CTTCCAGCTTTGATAATGAATTACCATTCAAAGCTAGAGTTTCGAATTTTTT

CATTGTATACAACCATTTGAACACAACTCTTTTCAATTATGCCATACATACA

TTTAGTTAATAAATTTTACCGATTAACTAGTACTGACAAAAGAAACAAAGA

GTAATTATATTTTTTTGATAAATTGTTTTATTAGAAAAATACTTAAAATTGA

TAAAAATAAATAAACCCAATTGATATATTTGATATTACAATACCAGATATT
```

-continued

GAAACAAATAAGACATGTTTTGTCTATATACTTCCAACTAGAAGATATTTAT

TTATCCATATCCTAGATATTTTAATGTGTGAATCTAATACATTCTCTTATATA

CGACCAAATAGTAAAACAATATGCCTCTCCTGCAATTTTTCTTCATCCAATA

TTTCTACCCAGCTTTCTTGTACAAAGTTGGCATTATAAGAAAGCATTGC

TTATCAATTTGTTGCAACGAACAGGTCACTATCAGTCAAAATAAAATCA

TTATTTG

AT4G23290pro6 (-1105 to +16; SEQ ID NO: 85)
CAAATAATGATTTTATTTTGACTGATAGTGACCTGTTCGTTGCAACAAA

TTGATAAGCAATGCTTTTTTATAATGCCAACTTTGTACAAAAAAGCAGG

CTGAACAGATAAGTGAAGTTTCTCTGCGATTTTTCTAATGTTGAATCCATCA

AACTAATAAGTGGTCCCTAAACCTACATAGTCGATGGTAAAATGTCAATAA

TGTTTGAAAGTTTAGATAATACCCTGAAAATGACGAGTCCCTTCGTTTACTT

GTAATAATGGGTGAGAACTACGACACAGTTCCATAGCAACTTTCATATTTC

GAGAATTAAATTATATTCCGCAGCAAATGCTATGTCCTTGTAAAGCTCTGTT

TTTAGTCTATGACCATACTTGTAAAACATGTTGTTTTTTTTGTGTGAATTAA

CAGTTCATTCAAAATAAAAATAAATAAATAAATAATCGAAAATGTAACTCT

GTGGTTATTGTAGCTTGAAAAAACGAATAATCAAGTGTGTTGTTCATTCTCT

TCGTTCGTTGCACACTGGTATAGCTTGTTGCTGTCATCTACTGCTGACTCCA

GCGATAATGAAACGATCAGAACCACGAAATTTACTAGAACTCAGCTTATCG

GAACTTGGAAGGGGACCAGATGAGTATTAGGCTAATTCGTCGTGTTGTATT

TTTCAACTAATGCGTCAGTGTCGTTTTTATTTTCAACTAATGCGTCAGTGTC

ATTAGTTTCGGAAATAAACGATATTTGTTTTGTTTTTGTATTGGGTCCTATAT

CGAGCGAGATTGGCATGTGAGTTGGGTTGGCTAGGGAAAATGGTAAAATCT

CCACATTTTGTTTTGAAAATGTGAAAAATACATTTTTCCCTACAGCGGGGAT

ATGAATCAGTACTATTTATAATGCAAGATATGTAAATTTAAAAGACATCAT

AAGAAAAACAAAACTACAGAATTTCGCTTAAGCTTTCAAAGATATCGATTT

GAATATAATGGTGCATTTGCGGGGTTCAGTTTCCACGGAACCGGTAAATTT

AAAAGCCAAATACCTTAAAAGAGTTGTGAAACAGGGTTACAAATATACATA

GTGGATTCGTATGAAAAAGAAGGGAGGAATGAGTCCTACACGTAGTCACAT

CACATATGAAAGAGATTGCTTTTGAAAATCGAATCCTCTTCTAATATTAAAT

CTTTCAAGACTGGAGGTTTTAAACAAGAAAATCAAACTCGACCCAGCTTT

CTTGTACAAAGTTGGCATTATAAGAAAGCATTGCTTATCAATTTGTTGC

AACGAACAGGTCACTATCAGTCAAAATAAAATCATTATTTG

AT1G07180pro7 (-1406 to +94; SEQ ID NO: 86)
CAAATAATGATTTTATTTTGACTGATAGTGACCTGTTCGTTGCAACAAA

TTGATAAGCAATGCTTTTTTATAATGCCAACTTTGTACAAAAAAGCAGG

CTTTAATAAATTAGTAATGAACACCTAGACTCGTATCTTCTAATCTCAATGT

TTAATGAATGGTAAAAATAATTATTTAATTTTCCGTGGTCAACAATGCATAA

TCTTTTTATTTATTTTGTCTTCTTACCTTTCAAAAATTTCTCAACTTGTCAAC

AGAAAAAATAAAAATCCCAATAACAAAGGTGACAACCGAAACAGAAGCAC

ATGACCACAATGCTAAAGATGGATAAAAAAAATAGAGCAAAAAGAAAGAC

AAAAATTTCAGTAGTCAAGAGTATAATTAAGCACGTATAATTTGCAAAATT

-continued

TTTATTTTATTTTTATGAACCGTTTGGTGTATATATATAATCCTTGCTTTCCA

GTTTTGATGATCTTTTTGTGCTACTTTGTATGCGGTTAAAGATTGTTGTAATA

GGCAAAGAAATCTTAAGTAATGCCTCAGCTGTTAAACGTTGTGATCTCCTCT

GTTCAAAATATTTCAAGTTGATCTTACTTATGGTAATGCTCTACTCGTGATT

GTGAGTTTGAACTAGTCACTGTTAAGGTTTTCTTTATAATTGATTGTCAAGC

TAATGAATAAGTTTGTGAATGAGGTTTTAGAAAGATGCATGATTGGAAGTT

GTGTTTAGTAAATGCTTCTCATTACAACTAGAATTTACTATAGAATCATAGA

ACGGCCATAACCAAACTTCATGAGTCCGGTGATATTATTGGAATAGAATTC

ACATAATTTTCATACTTTTGTTACTTAGACTGTCTACATAATGCCACATAAT

GAAAATTTGAATTAGAAAACTTGAATACTAAATCTACAGATATTTCAAGTG

ACTTCTAATGTATGACAATAAGACATTAAGACCCCTTCCATATCATGACCAT

TTCAAACTCGTGTCAATATGTAACCCATTTATCGTGGGCCATAAACCCAAA

ATAATAAATCATGTATATAAACGGGCTATTGGGCCATAAACTAGTGATAAT

AAGCTTTGGGGCGACGATCTCTGGATACGTCACCCCTCGCGATACAATTAC

AACCGATCAAGGTCAGCGAATACTCCGACATCCTTTTCTTGCGGCCCACAT

CGGTCTTTAGTGAATCACATGTTTTTTCTATTGTCGTTTCTTGCGCATCAAGT

TCTGCTGAGGTTTCTTGTTATTTTATTTTTGAAATTTTTCAACACCTTTAACT

TATCTCGATTTTGTTTACCACTTAAAAAACGCCCAACCAATGGCATACACTG

AAAATGTTTTCTAAACATTTAATATTTCTGTGGCTACCAAAAAGAAATCAA

GAGTTATTTTCCATTTATTCTGGGTGAAAGAGAAACAGAGTGCCACCTGTC

ATTTCCTAATCTGGCACGTAGGTTTTTCTCATACGTATTACAGTGAATAATA

CAGTATACCAAAGGCGGCTCGTAGCAGAGTTTGTTCGATTCTCTTAACCAC

ATTAGGTTTGGAGTATTATTTGCTTCTCTCGATTGAAGAAGAGTACCTAAAG

AATCACCCAGCTTTCTTGTACAAAGTTGGCATTATAAGAAAGCATTGCT

TATCAATTTGTTGCAACGAACAGGTCACTATCAGTCAAAATAAAATCAT

TATTTG

AT1G65490pro8 (-1479 to +21; SEQ ID NO: 87)
CAAATAATGATTTTATTTTGACTGATAGTGACCTGTTCGTTGCAACAAA

TTGATAAGCAATGCTTTTTTATAATGCCAACTTTGTACAAAAAAGCAGG

CTACCGCTTAATATCGTATGATTAGTATTAAAAATCTTCTCCAGAATTTCAA

CGTTGTTTTTGCTACTCACGCATTGTACCTTAAATGATCTTATTCATCATTTC

TAACAAAACAATTTATGCATTCTTCGCCAGTAGAAGAACCTAGTAGAGTGC

TATCGGCAACAACTCCGTCTTGTTCATGCGGATGCAAAAGAAGACGTCCAT

GCCCACGTCCACGTCCATGTCCACCTCCACGTCCACACTATTCAAGAAATTA

TACAGACCCTTGAAAAAGAAGAATGAAGAAGAGAAAACAAGGATCAATTA

TGGGATTGGTACAATATAGTTGAGGGTATTGTCTAATGTAGTACTTTTGAAT

ATGCTTATAGATTTAGACATATTAAAGACTATTTCTCCTTTTAAATCAATG

AAGAAAATACTTGAGTTCAATCCTTCTTTTGCCTTTGCATAACCGTCTCTCA

TCCACACCAACAAAACAAATCCCAGAACCTTCTTTTGCAGAATTTTAAAGA

CACACAAAGCAATGAATAAGAACACTTGGTTTACAATAACGATCGAAACTG

GTTTACAATAATGACCGAATATGGTTTGCAAATATAGATGAATTGGAATTT

-continued

```
AATTGATTCGATCTATATCTAAAATTAAATTTCTTGGGTTCCCTAAATACTA

TCCTCTTAGGGTTTAGATTTCTATTATCAAAACTCTCGTTTAATTTGAGCAA

ATTGGTTAATCGGAGAGGTTAGGGAAAACAACGTTTTCTGGTATAAAGAGA

CGAGAGAAACGGTATTGATGGAGTTAAAAGTGATGATGTTGATGAAATACT

GAGTCAACGTTAATAAGGCAAGAGCCGACTGTGAGAAGCAAGGTTTCATG

GTTGGGAATTTTGTTGCGCAACGGAGAAGATGAAGTGAATTTTGTTGCGCA

ACGGATTTCCGCAAGCTTTTCCCGAGAAAACAAAGATATCATCTACATTCT

ATTTTTGTGCTGTAACTTTTCTGAATTTTTTGTAAACAATTTTTTGTGATATA

TATATATATATAAACAATTTTATATCATTAAGTATGGTACTCTTTAATGTTTT

TAACGGAACATGACCAAAACTGCTAGTGAAAGCATTTTGTCTTAACTTTAC

AAAAGAAGTTATCTTTTTTTTAACACAAACTGGTTTTCTTCGGTAAATAAAA

AGACTAAGTTTGTAAATTTATTCTTAGACAATTATTTACTATTATTGCCGAC

TAATATGAAAATGCAAAGAAGTCGTATTTGGCATTATCCAAAAGAAGGGAC

AAAACACTTATCTCTTAAAACTTAAATTTTAAGCCATTCGTTTACCAACAAT

GAATCTTGTGGCTGATGTAGAAACCGCGTTCACTTGTCAACATTTAGAAAT

AATGTTGGCTTTCAAAGAATTAAATAGAAACAACCAAAATGTATGAGGTTG

AGCGTCTTCTATATATTTATTACAAGACTTGCGATGACCAAAAACGCAACG

AAGAACGAAACCCAGCTTTCTTGTACAAAGTTGGCATTATAAGAAAGCA

TTGCTTATCAATTTGTTGCAACGAACAGGTCACTATCAGTCAAAATAAA

ATCATTATTTG

AT1G21670pro9 (-1332 to +11; SEQ ID NO: 88)
CAAATAATGATTTTATTTTGACTGATAGTGACCTGTTCGTTGCAACAAA

TTGATAAGCAATGCTTTTTTATAATGCCAACTTTGTACAAAAAAGCAGG

CTAGCTTATAGCGTAGAGATGATTCACTGATGTTAGTTTCATTCCTATGGAA

TAACAAAATGCTTTTGATGGTATCTTCATGAACATGTACGTTCACAACTATC

TTTGTAGCTCTATAACTATTTGGTAACTCCGGTTTAAGCAAAGTTCTACACT

TTAATAATATCGACTTCGTTAATATATACAAATGAAAATAGTCTTATAGATG

CGAGAGCAAATGTTTGAGGGTAGGTTAAAGGAATCTTGAGATATGGATAAA

CGACACTAAGTTGTGTCGTAGCGAGACAGATCCAAACTACGACAAGTAGTA

AACGGAGATAATAATATCCAAACCATAAGAATCCATGAAAGCAAGTAGAC

AACTGCGACTTTGCCTCACCAGTCACCATACTAATAATTGGAGAGGTGGAT

CTCTTAGGAATATTTACTTTTATAAAAGATCAGAGGCTAGTCAGAACTCAG

GGACTAAATTTTATTTTCAGTAGTGACATCTTTAAAAGACAACAGAGATTTA

TAAAACTCCACGTGTACAGAAGTGAAACAGTCTGACATGATGCCTGATGCT

AACTAACTATGTAAGATAAGACATATCTTACATAGTTAGTTACCATGTAAT

AGTAAGTGATAACCCAAAAATGCAAAAAAAAACATCCAACTAGAACATGT

GATATGTCAGTATGTGTATGAGATCATGTGCACAATAATATTATCGGTATTT

GTATGTCTAGTTGTCTACACTCTACAGCTCTTACTGGAAATAGATTTTGAGG

AACAAGAAATAGTTGAATGAGTCATTGCTATCTTCTAGATTTTTTTTTTTCT

GTCATAATATCTTCTAGAATTTTATTACTTGGGAAAGCGATATATGATATAT

TCTTTTTCCAAAATTTACTAATTAAAAAAAAAAAAAAAACTAAGCACTCT
```

-continued

GTATTTATTGCCATATTGAAAATGCTCTTTCCACCAATATTCCTTATTTGCCT

CAAATCATTACTTTCGGATTCTACTGTCTTGAACTGTGTTCATGTGTGTATTC

CCTCATCAATCACCTTCAATTCATATTTTCCTATTTCCAAAAATAAAAAGAT

ACAGTATCTATGTATTTAATTATATATCATATCAATTATATCATAATAATCA

TAAGATCCTTTTTATCGAAATAAAAAAGGAAACAAATCCAATCATAGCAAG

CTTTTTCTTTTATTTAATAAACAAAAATAAAAAGCTTCCCGAAATGGTTAAA

ATCCAGAACCACTAAAGTCAACCAAATTTGTCAAATTCATCCACGTCATCA

GTTCCATCTATAAAACGCTCACGCCATTCGTCAAGTCCCAAAACAAGAGTC

CACCACCCAGCTTTCTTGTACAAAGTTGGCATTATAAGAAAGCATTGCT

TATCAATTTGTTGCAACGAACAGGTCACTATCAGTCAAAATAAAATCAT

TATTTG

AT2G17450pro10 (-1397 to +103; SEQ ID NO: 89)
CAAATAATGATTTTATTTTGACTGATAGTGACCTGTTCGTTGCAACAAA

TTGATAAGCAATGCTTTTTATAATGCCAACTTTGTACAAAAAAGCAGG

CTAGTAAAGAGAATGATTATTGAGAATTTGAGATTGACTTTATATATGGTTT

AGACACGGTTTAGACACGGTTTAGAGCTTGATTTAGTCATAAAAGAGTCAA

GTGGTTGAGGTGTGAACTTCATATTTAAAGTGACGAATATCAAAAGTATAT

AGAATAGACGTGTACCTGCGGTTTAATAATTCCTATTAAAATTCACCAATAC

ATTACGTGTCAAATTGTATCCTACAGTATTTAGATTTATAATATATGCATCG

CTACCAAATTTATGGACACGTTGATCCACTTTCAAAGATTCTGTTTTCGGTA

ATAGATTTAGAATCCAGATCTCACCTAGGCTTACAAAAACAAAACTTACAA

GATCCAAAATATATTAAAAGACGATTTAAACAAAAACCAAATACATTAGAA

GCAAAATGTGAATTTCGAGGTTCTAGCTTAAAAATAAATCGTATATACTAA

TAATGGTCGGTTAAATGGCTGGTCAAAAAAAAAACTGATATTAAGAAACT

AGAATGTTTAAAAATATTTTAAGAAATAAAAGTGCAATAAGCTAATATTGG

CCGGTGTTATTAAAAAATAACATACTATTTCCACAATTTGATCTCTCATTTG

TCTTTTTCCATCTATTTTTATTTATTATGATAGAAAATCATATTATCCAAAAT

ATTTTTAAATAAATGTAAGAGAATTAAAAATAAAATGGTCTAATCGAAGGT

AGGTTTAGCCGTTTAGGTGAGAAAAGAGCTTACTTATACCTTTTGATAATGT

GTTCGTCAAAACAGAACCTATAAAGCCAACCTCCACCGACCCATCTTTTCTT

CTTATATTATTTACTCCAAGTTTCCTTCCAATTTCAAAAAATATAATCATCTC

TCTCACTATCTGAATTTTAAATAACATACAACAAATATTTTTAATATATAGA

ATAAAATCAAAATAAGTCATCATGATCTCAACATCAGTTGACTAGTCATAA

GAGAATTTCATAACAAAAATTGAACATACACACACCCAAGAAAAGAAAAT

AAACTTTTTATTTATTTATAATCCTAAGAAAAAAATGGTTTGTGATCTAAG

AAGTTGGAGATAGATAGATGCATCTCCATTAAGAGCAAAATGTTTGTTTTT

AAACAGAATATGTGTCCACACGAAACAACAATACTCTAAATAGGAGATGC

AAATTGCATGTAAACACTAATTCAGCCAATAACTTCGAATAAACAACCAAA

TAATAATACTTACTAATTTTGTTTCCCTTCATCCAAACTTTTCTGCGTGTATT

ATTATTATCATACAGATTTGATATTAAATATTACAAATATCTTATTTGTTTGC

AATATTATTATATAAGTAAAGATGTATATCATAATGTATGTATCCTTTATGT

```
GTCTCTATTATAACGTGGATCAAGATTCTTTCTTATCTTCATCACTCCACAC

ATTTTCTTGTCTTCAAACTCACACAAAGAAAGAAAAGTCTCCAAAGCTCAA

AAAGCAACCCAGCTTTCTTGTACAAAGTTGGCATTATAAGAAAGCATTG

CTTATCAATTTGTTGCAACGAACAGGTCACTATCAGTCAAAATAAAATC

ATTATTTG

AT4G01130pro11 (-1349 to +35; SEQ ID NO: 90)
CAAATAATGATTTTATTTTGACTGATAGTGACCTGTTCGTTGCAACAAA

TTGATAAGCAATGCTTTTTTATAATGCCAACTTTGTACAAAAAAGCAGG

CTAAAGAAGAGAGAGGAAGGAGAAGAGAAGAAAAAGAAGAGAGACACAA

CGGAGCGCCAAGAGGCTGATGAACACGTCACCGTACACGTGTCATGATCTT

GAAGGGTTTGCAAAGGGAACGCATATGCTGAGCTGGCAACCCTAGATCTGC

GCTGGACATTTTAAATATCTGACTTAAATAATGATTGGTACACGTAGTCATA

ATCGCCACCGTTCATCTTGAGATCTCTACGTAGACTTGACGTGCTGCTGATT

TTATTCCTTTTAAATAATGAAAATACAGAATTAAACTATAATGTATAATTCA

TTTGAGATCCACAGATGACGAAACGTGGACTACCAAATCAAGCATATTTGT

TTTTACCATTTAATCGACGGCTAATATTGATTTCATCTACGGTAAAATATAT

CTTTTTTTAACCAGAAAAAGGTTAGAGTGGTCCCCACTGTAGGATCTACTGA

CTTGTGTCGGCCGTTAGTGGTTTTATAAAGCTGACGTGTCCCACTGAATAAG

GAATACCGTTGTGGTCCCTACGGACAACGTGGGATTCGACGCCAGCTCATT

TTTTAATTTTTTCTTGAAATCTTTTTTAAAATTTTAGACGATGACTCAATCTT

CGCCACGTAGGATCCACCCAATAAAAAAGGGTTAACAAAATCTTATCTTTA

ATGCTAAATTAGTTGAGATTAATCCATGTTGTTTAAATCCGAAATGATGCAT

ATAATCTTGTTTCTTATAATCATTAAGATTTAGACTGAAGATCTAATTCCAA

TTTAAGAGAGTCACTAAAAAAAGAATGAATTCAATTTCAGACAAATCCGAC

AAGGTCAAGGTGACGTGTTCTTGATGCCAATTCTAGTGGGAGCCACTTGAC

GCGTGCAGTTAGACTCCCGGTCCAAGACATAAATTTACGTTAATACCCTCCT

TTATTGGGTTATTATTGGGCCGTAGTTGAATTATTAGACCCAACCTTTTTAT

CCTGTTCTTGATTGGCACATACTTTGCAAAAAGTTAACAAAATAACTTTTAT

TGCAAGGCATTACAAGAGAAATGTCAAATTTGGTTGTTGCATACATGACAT

CTTATTCATATCCAATCCATAAATTGATGTGTTGTTATTCAAACTGGTCTTTT

GATGTATTGTTAGACATATCTCATATATATTGAACCCTTGGAATCAATATAA

TAGATTGGGCTTTATTTATCTTTTATTGGGCTTAAAGGGAATTGTTGGACTA

AAAAAACCATTAAGGCTATAACACACTAATTACACGTACAATGAGAGTGAG

AGTCACGGACGGGATGATTACAAGAATCATATAGCACCAAATATCTCATCC

TCACTCTCACATACAAACACACATTTTGTTCACACAGAGATAGACACCCAG

CTTTCTTGTACAAAGTTGGCATTATAAGAAAGCATTGCTTATCAATTTG

TTGCAACGAACAGGTCACTATCAGTCAAAATAAAATCATTATTTG

AT5G19240pro12 (-1420 to +80; SEQ ID NO: 91)
CAAATAATGATTTTATTTTGACTGATAGTGACCTGTTCGTTGCAACAAA

TTGATAAGCAATGCTTTTTTATAATGCCAACTTTGTACAAAAAAGCAGG

CTAAGTCATACAACATCAGTTTTTGTTTTGTATTCAGATTTTAAGACGTTCC

TCTATTGTCTATTTGTCTTGATCTGTCTTGCAATGGCATATTCTGCTGGAGGA
```

-continued

AACCTATGTCAAGGAAAGATACACAAAATTTGCCGGATGAAATAGTGTTAA

CAATATTTTCTTAGAGCATACTCATTGCTGAACTATTTTTTTGAATGTTTCA

AAACCAAAATATTAAATATTTTAATATCAAAAACAAACTAACTATTAAAAA

GAAGACATACGGAGAAAAGAGTCTTTAAACAAACGTTACAAGGTCTTAAAT

GTCTCTAGGAAGACACATATCTCATATCGATTCTTTAAATTCTTTTATTTTA

TGACCAATGGGGATGGTCTTAGGAATATAATATCGCAATGTTGACCAATAA

CCAATAATATTAATGTAATTTCGCAATATAGTCTATTATTTTTATTTTTATCT

TATATTTTATTTTATTTTTTTGGTCAAATTTAGTCTCCTATCTTATGTCAT GC

AAATAATGGAGATGATGATGTAAGATAAGAAAGAAAATTCAAGTTTTTGCT

GAATTTATTAGTATTTTTGAAAAAATAAATAAACTAAGAATAAATGTTTGG

TGGATTCAACTAATTGTATATTTATTCCAATGTTCAAAAAATCGTTAGGCGG

TAACTAGGTGTTCGATAGAGACTTAGCACCCAGAGCGAGTAATCGGAGTCT

AGGCGATAGCACATTATTTCTTACTTTTAAATATTTTTTTACAATTTTCTATC

AAAACATTGGTTATAAAATATGAAATTTTAAAAATGTTATCTATTTAAAACT

TATTATATTTTCACACTTTTATATATAAAAATAAAATAATTTAGTCTTAAAA

CTAAAAAAGTTGAGAATAATTAATTCATAATTTAGAATTTTAGTACTTAAAT

ATTTTGTTTATCTTACTTTGATTTAAGTATTTCACTTATTCAAGATGATGTTA

TATCGAAAAGAAAAAAAAAAACAAATCAGGCACTAAATCGGTCAATTTGA

CTGATTTAACCGATTAATACTAATTTTGAACGCCTAAACCAGTAAACCAAT

GTTTATTTACCATCTAAATAAATTTTTTAAACATTGATTTATTATGTGAGAG

AGAAAAAAAACAAACTGATAGAACCTTTTTTTTTTTGAACAAACTTGTAGT

CTTGTAGAACTCAATATCAAGTATTAAATGGCCATAATTTCGCTCTTAAATT

TGAATGAAGGAAAGAAACTTCCTACTTGGTGAAAAAAAAACAAAAGGAAA

GAAATACCCCACTAAAACGAGTAACGACATCTTAATGGGGTCGTTATTTTT

GTCTACGCGGCATCAAATCGAGTGGACAATAAGAACTAAACCGAAGCAAC

GACTTTGAATAGTCAAGCGAAAAGGAGCCAAATTCTCTAATAAATAAGTGA

AGATTCATCGCCAAGTATCATCAGCAAACCTAAAGCTAAAAGTGCCTCTGC

ATCAACCCAGCTTTCTTGTACAAAGTTGGCATTATAAGAAAGCATTGCT

TATCAATTTGTTGCAACGAACAGGTCACTATCAGTCAAAATAAAATCAT

TATTTG

AT5G58120pro13 (-852 to -1; SEQ ID NO: 92)
CAAATAATGATTTTATTTTGACTGATAGTGACCTGTTCGTTGCAACAAA

TTGATAAGCAATGCTTTTTATAATGCCAACTTTGTACAAAAAAGCAGG

CTAAGTGTAGATTATTACAAGTATATATATATGACTACTATATTTTGGTTAT

ATGCTTATACATTTTGGATATATGTTCGGGTACTCATTCGGTTCGAGTTTGG

TTATGGTTCTCGGGTCTTGAGGTTTTGATCCCGTTCATGTATTTTTGCCAGTT

CGAGTTGGGGTTGGTTCTGTTTACTTTTTCTAGTCCATGTATTTTGCAGACCT

ATTAAAACCATTCTGTTTTTTTTTGGACCAACAAAACCCATCCGTTTTTAG

ATACGAAAATAAAATTTTATTAAAACCATTATTTTTCTTGGACCATCAAAAC

CCATCCGTTTAAAGATACGAAATGAAATTCGATTGATAAATACAAAATAAA

GTTCACCAAACTTAAATAAAAAGGCATAGATGGGACCAATGAGAAAGAAA

-continued

TTTCTTTTCTCCTCAATTTCCCCAAAAATATATAAACCTTAAGTTTACTTTTT

TGTTGCAAGGAAAAACATTAATCTTTTTCAACTTTCTAAAAACAATCATTTC

AAACGTTAAAGGAACCTCCTCCTTTCTTTACGCGTTTGCAATATAACCCAAG

AAGACCGCTTGTTTGTACAACTTTCCAAAAACCAAACAGTAGTGTAATAAA

CCTCTGACTTCTTTTTTCTTCTCTATTTTTGTGGGTGATAATCAATTCACTCG

GTTTGAAATTTCGTCCACTTTTCAAAGATGAGTGAATGAAAAAGCCACGAA

ACTTTCCATTTCTTCCTCTGTGTATAACTCTCACTGAGTACGACTTGCCATTT

TCTCATCCAAAAAAAATGTTTATCCAAATACATATTTGTGAACTTTGCTTTT

AAACCACTCAAGATTCTTCCCCACCCAGCTTTCTTGTACAAAGTTGGCAT

TATAAGAAAGCATTGCTTATCAATTTGTTGCAACGAACAGGTCACTATC

AGTCAAAATAAAATCATTATTTG

AT3G47340pro14 (-1300 to +200; SEQ ID NO: 93)
CAAATAATGATTTTATTTTGACTGATAGTGACCTGTTCGTTGCAACAAA

TTGATAAGCAATGCTTTTTATAATGCCAACTTTGTACAAAAAAGCAGG

CTATTTCAATCATTTATAGCTGAAGGTGTACCATATAGATAGATAGGGACA

CCAGCAATTTTTACATATAAAAAAGAAAAAAATATCAAACGATTTACAATG

TATCATGTCGCGATTGGGTCTTGCTGCCTCAAGAATAGGGCTGATATCTCGT

TTTGTCCAATCAAAGAAAAAACACGTCATATTCTTATTTTGATGATTTATAT

ATTAGCATTATCCAAAGTCCAAAGATTATAAACTGAGATTCATCTTCTCGCC

CTTGCACATTGTAGCAACGTGTGAGGCATGTGCGATGCCTATACCTACAATT

CACATGTGATCCGGTATATTAAAATATACATGATTTATGGATACACTCGAAT

ACTTCTCCGATATTCATTTCGCGGAAAGTTGCATATGATCCACTATCTCCTA

TATATTTGTTATATAACACATGGCAAATCTCTCTATATATATTTTTTAAATAC

ACATATATCCAAAATAGGCTTAACTATAACACAAAGACTTTTGTTTACTGTA

TATTAGTAAGAAGTAAATGTATTTTTTAATATTATGATAAAGTTTGTGAAAT

CACCATTTGCAATAGCCATATAGGGTCGTGTTTTAATTTTACAGTTTGTATT

GTTATAATTCGATTCCAAGGTTGAGAATATGTGTGTACTATTAGACTATACA

AATAATAATTCGTTGACGATATTGAATATTTACTAATTATAGGAAGAGAAA

ATTATTTACTAACTATAGTACGATATATTTCTTCTATATGTGTTTTTAACGTT

TTTTTTTTTTAAATTTAAGTCTTAACTTTACTTCTCATTTTTAATCAAAAGG

AAAAAAATACCAATCAATTTTTCCTAACACAGTTTACTTATCATTTTCATTT

GAAATGTGTTCACTTTCTGATAAAATGCTAATCCTACAATCAAATACACCAT

TGTCGTGATAACACGTGTACGGCTCTAAAGCAATCAGAACAATCATTGGAC

AGTTTTTACACCGTCAGATAAGTACCTATCCACTTGCTGACTCAGCCGGATA

AACCCTAAACCGGAAGTTTGCCCCACCGTCAAAATTGGAAGAAACCGGAC

AAAAGAGAATGTAAAGACTAAGAAGTAAGAACCCATCGGACGTCGTAAGA

AGGTTAATTAACACGTGGAAACAGCTGGTCAGAGTTATCCGGTAACTTATC

CGGTTACAAGTAAAAAAATAATTTGTTCCCATACACGACTCCTTCAGAACC

AAACGCGACATCACGGCGCCGTTTAGTGTCTATAAATAGAGCAATCGGTCG

TAGAAAACCAAGACATCAAAAACACGAATATCGATAGTACACTTCTACGTG

CAATTTTCTCCTTTCTCTTCCTGGACATCTGTCTGTTTATTACATTTTCTTGTA

-continued

ATCTCTTTTTGGGGTTTTACAATATCTATCCCCTAAAGTTTCGGAAAATTCT

GTTTTTCTGTTCTCATTCTTCGTGATCTTTTTCACTTTCTTCAAAAAAAAAAC

ACCCAGCTTTCTTGTACAAAGTTGGCATTATAAGAAAGCATTGCTTATC

AATTTGTTGCAACGAACAGGTCACTATCAGTCAAAATAAAATCATTATT

TG

AT3G59350ter1 (3'- downstream region; +2199 to +2629; SEQ ID NO: 94)
CAAATAATGATTTTATTTTGACTGATAGTGACCTGTTCGTTGCAACAAA

TTGATGAGCAATGCTTTTTTATAATGCCAACTTTGTATAATAAAGTTGTA

TTCTTCTGTGCAATAGCAACAATGGAAGATTGGGTTCGGTTTCAGTTGTTGC

CATACCGTATAAATGTGTTCTTAAAGAGAGTCTTTTTGTCGAGGCTTTTCTT

CAGTTGGGATGTATATGTTTTATTAAGGTGATGAGTAGTGATTTGGTGTGTC

TTTTCAAATGCTTTGTGGAGTCTGTTTTTCCTTATAAAAATTTATTCTAAATC

TGGTTTGTATTTTGGGGGTCTTCTTTGCTCTTTCTTCATTAACAGAATACTAA

TTATAAGCTTTTCATATACAAACCTTGAAAGGAATTTTCATCAGTTACTAAT

TCGATTTCAGAGAAATGAATCATTCAAAACACTTGATTAGAGAAATGCTTC

TTGAACCGGGTCGGTTTAACGAAATCCACTGGCTGGAAAAATTATGCTTTT

ATATATATAAGAAGCACCCAGCTTTCTTGTACAAAGTTGGCATTATAAG

AAAGCATTGCTTATCAATTTGTTGCAACGAACAGGTCACTATCAGTCAA

AATAAAATCATTATTTG

AT4G32340ter2 (3'- downstream region; +1566 to +2438; SEQ ID NO: 95)
CAAATAATGATTTTATTTTGACTGATAGTGACCTGTTCGTTGCAACAAA

TTGATGAGCAATGCTTTTTTATAATGCCAACTTTGTATAATAAAGTTGTA

CTCTTTGTGCTGATGTTAAACCGGTGTAATACAATGAAAACTCAAAGGTCC

GGTTTAATCAGGAAAATATCTTCTGCACACATTGAAGTAGATTGATGCTAA

TGTGTATCAAAAGGTCCAAAGCCGCATTATTGTTGCAAAATGCGGATTGCA

AAGAAGATAATAGTGGTTTGTGTCCTTAGGTTTAGAGCTAAAAAAGGTGTG

AAAATGAGACTTGTGAGCGAATCAATTATTGATCAATGGTTACGAGAGATG

TCACGCTCAACTGTCGTTATGTCTTTGACAGTTGCAATTTGCCCATAAAACT

TTCTTGCTAGAGGTTATCCGCAAACAAACCACTAATTCAACCTCTTAGCTAC

AATATCTTCATGTACGTTTTTGTCGAAATCTCAAAATCCATCTCCTACAATA

TCATGTTTACTAATTACACTTTGATGGATAGCCACAAAATTTTGGAAAGAA

GAGAATCAATTATATAACAAAAGAATTTGCACATAAGCCATAATAACAAAA

ATAAGAAAAAGGAAAAGAAAAGAATACACAGACAGAACGAAAGCAGTA

TCTCCTGAATATTCACCTTTTAGGATTGAAAGCATCAAAAAGAAAAAGAAG

GAAGATCTTGACATAAAAGAAAGAAAAAAACACCTTAAAAGATTAAAAAC

ATTACCATCAAACATAGGAATATATAAAAGCACAGCAACCTTTAGAACCAA

ATCCACATGATTCTGTCCACTCTTTTTACCCATCTCTTCTCATATAAGTTTTG

GCTGAAGATATATATAAATATTATACGGTTTCTTTCTCTCTTGTCCTCCTTAC

TTAATGCAAGAGATATGATGAGTCTTGAGAGTAATGATCGTACCGCAGAGT

TTCACCCAGCTTTCTTGTACAAAGTTGGCATTATAAGAAAGCATTGCTT

ATCAATTTGTTGCAACGAACAGGTCACTATCAGTCAAAATAAAATCATT

ATTTG

-continued

AT5G23240ter3 (3'- downstream region; +1869 to +2113; SEQ ID NO: 96)
CAAATAATGATTTTATTTTGACTGATAGTGACCTGTTCGTTGCAACAAA

TTGATGAGCAATGCTTTTTATAATGCCAACTTTGTATAATAAAGTTGTA

GATTCATAGATCATATATATGTACATCATATCCCTCTTTAGAGCAGGTACTC

GTGTTCACCTGCAAATGTAACAAAGAACATTATACTATACAACAAATATAC

ACATTGAATTATACCTGTATAACCAACATAGGTCAAGATTACATCATACGT

GGGCTAGGCCCATTTTATATTGGCCCAATAAGTGAGTGACTAAATCCTTTCG

TTCCCAAATATATCTCCACCGATCAAGAGATTCATCTTCCACCCAGCTTTC

TTGTACAAAGTTGGCATTATAAGAAAGCATTGCTTATCAATTTGTTGCA

ACGAACAGGTCACTATCAGTCAAAATAAAATCATTATTTG

AT5G44050ter4 (3'- downstream region; +3727 to +4226; SEQ ID NO: 97)
CAAATAATGATTTTATTTTGACTGATAGTGACCTGTTCGTTGCAACAAA

TTGATGAGCAATGCTTTTTATAATGCCAACTTTGTATAATAAAGTTGTA

AGGTTGAAGAATAAGAATTAAAAAATTGTATTTAAACTATAAAATATGCAT

ACATAATAAATTTTGATCGTTTTTAACTAATAAAACATATGGTGTATCATTT

CAATCTCACATGAATTAAATCTTGGTGTGTATAGACTATACAGTATAGTAGT

TTGTTTTGTAAACCGAAATCAGAACACTGGCTGCTGGCCGGTTTACTTAATT

TATGAATCTATATATACATTTTTGCAGTCATTTTGTGAAATAAATCCTGTAG

TTGGGACTTATTTACAATGGCTGCCACTGGATTTTAATGTTTGTTTTTGATA

ATTAGAAAAAAAATCTTCGAATTAAATATTTTACATTTAACAATCTTCCCTA

AATCTCTCCACATTAACTACACGGTTAGTTACTAAAATTAAACTTCCAAAAT

ATTTAATATCATTTAATTACTACAAAATTATCATTTTTGATATTGTTTTCTC

CATGACTATAACAATTCGACTATAATCATCAACACCCAGCTTTCTTGTACA

AAGTTGGCATTATAAGAAAGCATTGCTTATCAATTTGTTGCAACGAACA

GGTCACTATCAGTCAAAATAAAATCATTATTTG

AT4G04330ter5 (3'- downstream region; +1899 to +2072; SEQ ID NO: 98)
CAAATAATGATTTTATTTTGACTGATAGTGACCTGTTCGTTGCAACAAA

TTGATGAGCAATGCTTTTTATAATGCCAACTTTGTATAATAAAGTTGTA

AACCGAATATCTCTTCGAATCACATTCATATATATAGAGTCTTGAGAGTATA

CACACTTGAAACCGTTTGTACATACATATACATACCATTGTGCTATGTTACT

CCCAGGTTTTGATACCTTAGTTTTTTTTACCTGCAAATCGATCAAAACCCGA

TTTTCTTTGCGGAGTTACCACCCAGCTTTCTTGTACAAAGTTGGCATTAT

AAGAAAGCATTGCTTATCAATTTGTTGCAACGAACAGGTCACTATCAGT

CAAAATAAAATCATTATTTG

AT4G23290ter6 (3'- downstream region; +2918 to +3417; SEQ ID NO: 99)
CAAATAATGATTTTATTTTGACTGATAGTGACCTGTTCGTTGCAACAAA

TTGATGAGCAATGCTTTTTATAATGCCAACTTTGTATAATAAAGTTGTA

AATTGGGCTAATGATTAACATGAATATTTTTCATAAGTCTAAAAATATGTTA

TTCTCTCTCTTTCAAAATACATTGAATTTGGTATTAGTTACTTTTATTTATTT

AAGTTTGGTGTTAACTTTAGTACTTTAAGCCAGAATTTTCTTTGAAAATCTA

AACGACCTTATTTTGAGAATTCTTTAAGAAAGTAAGTCTTGAAACAATTCG

AACAAGCTTAAGCTTAGTTTCAGCTTCTTATTCTTCCTTAGTAATTTCTCTTG

ATCCCGTGGCAAGTAGATTTATTCCTTTATTGTACGTATTGATGATGCCTCG

-continued

ATCACTTAGATGAGTCCTTGTTAAAGGGAACCAAACTTCAAATCCGACTAT

CATTTTCTTATTTTCTGGACAAAAAGTCTAAACTCATATATTACAGATGTTT

AAAATTTTGAATAGTTTTGTCTTTAACGAGGAGCTACACTAGTAATGGAAG

CTTCGTCGATTGAAAAGAGGTCAGATGTATCCACACCCAGCTTTCTTGTA

CAAAGTTGGCATTATAAGAAAGCATTGCTTATCAATTTGTTGCAACGAA

CAGGTCACTATCAGTCAAAATAAAATCATTATTTG

AT1G07180ter7 (3'- downstream region; +2455 to +2954; SEQ ID NO: 100)
CAAATAATGATTTTATTTTGACTGATAGTGACCTGTTCGTTGCAACAAA

TTGATGAGCAATGCTTTTTTATAATGCCAACTTTGTATAATAAAGTTGTA

TCCATATCCCCTCCACTTCGCCACGTGCTTCTTCTTCTCTATGTCTCTATCTT

GTTCACTTTATGACCTCTAATCAGTTGAAATCATATGTTGTTTACTTGGAAC

AATTCAATGAAATTCAGCATTTTAGAAAGACAGGGTATTGACTTTGAAATT

GAATCATCTGGTTTGACTGATAGTCAATTTAAATGGTATTAACTTTTGACTA

AGCACAGTTAGTTTTCAACATTTTTAAAATTGAACAATTAAATTGAAAAAA

CCTATAAGCTATGGTTAAAGATTGATTAGTAAAAAATGTTTGCTTTTGCATA

AGAGTAGAAAAAGTTTTATGGGTTTAATATTTTTTGTATCAAACATTTGAAA

TATTTCTTGTATATCTGTAAAATTATTTTAAAATATCTATTATAAGATTTATA

TGAGTTTTCCACTTCCACATGATTCATGTGATACAGAAAGTGCATCTCAAAA

CTTCTAGAGTTTCCCTACCAAAAAAAAAAAAACCACCCAGCTTTCTTGTAC

AAAGTTGGCATTATAAGAAAGCATTGCTTATCAATTTGTTGCAACGAAC

AGGTCACTATCAGTCAAAATAAAATCATTATTTG

AT1G65490ter8 (3'- downstream region; +406 to +905; SEQ ID NO: 101)
CAAATAATGATTTTATTTTGACTGATAGTGACCTGTTCGTTGCAACAAA

TTGATGAGCAATGCTTTTTTATAATGCCAACTTTGTATAATAAAGTTGTA

TACTTTGAGTTTGAGTTACTCTGTGTTCGAATTTTAAAGTATATGTGGTTTTC

TGTTTTAGTTTCGTGTCTCAACTCTCAAGTGTAGAGGAATGTTATAAACTAC

TATGCAATGAAGGAACTAATACTTATGATGGTATTTTACTAATTATGTTATT

ATTCATAATTCCATGCATTAGAGCCAATTGTCGCATTTTTTTCTTTCAGAAT

TCTTCAAACTTGTCAAATCGAAATCTCTTCTTTAGAAGCGACTAGATTAGTT

TTTTTCTTCAAAAGAAATTCTCTACTGAATTTATAATTTAAAGAGTTCACGA

GCTGCCTACTAAAATATGAAAAATATTTATGAATCCAGCAATACAAATTGT

AGCTTTGCAATACAAGAAAGAACAACTTTTCATAGAGATCAAAAACGCTAG

ATAAAAAAAAAACGGGGAAGACTAACTAGTAAGTACCACGAGTATAACAC

ATTTTTTGGATTTAGTTTCTATGATTGCTTTCGCACCCAGCTTTCTTGTAC

AAAGTTGGCATTATAAGAAAGCATTGCTTATCAATTTGTTGCAACGAAC

AGGTCACTATCAGTCAAAATAAAATCATTATTTG

AT1G21670ter9 (3'- downstream region; +2124 to +2607; SEQ ID NO: 102)
CAAATAATGATTTTATTTTGACTGATAGTGACCTGTTCGTTGCAACAAA

TTGATGAGCAATGCTTTTTTATAATGCCAACTTTGTATAATAAAGTTGTA

TTTGTTATGTAACTTATTCTTCTAATAAAAAACTCCGCTAGTTCATATCTTGT

TAAGTATTTGGTTAGCCTAAGAAATTATATAGCTTGAGGTTTCACATTTTCA

ATATTTTTTAAAAATAATTTGGGTCAATATTGATGTTGGAAATGAAATCAAC

```
GGTTGAATTATTGTCGTGTGCTGCTTGCACCATGGTCCATGCTAGATGGACC

GACCACTATTTTTCCAAACAGTGCCTATCCTATCAAGTAGATATTTTCTGAA

TACGTAGATAATTGTAGAATACAAGAAAAGAAATATCCTCTGTGGAATAAA

TGAATAATATACTTTTGTCAGAAACGTTACAAGTTAAAATTCCACGACTGAT

TGCCACGTGTAAGCTTATCTCAAAAGGGCCCTACAGTACCATGATGACGTC

ATCTCTTACACCACTCTCTGAAAAATTCCTCCGCCTTATAAAAAAACTCGAT

TATCGTCTTCACTTAGTCACCCAGCTTTCTTGTACAAAGTTGGCATTATA

AGAAAGCATTGCTTATCAATTTGTTGCAACGAACAGGTCACTATCAGTC

AAAATAAAATCATTATTTG

AT2G17450ter10 (3'- downstream region; +662 to +1161; SEQ ID NO: 103)
CAAATAATGATTTTATTTTGACTGATAGTGACCTGTTCGTTGCAACAAA

TTGATGAGCAATGCTTTTTATAATGCCAACTTTGTATAATAAAGTTGTA

TTAACACTAATTTTTGTTTTATTATGGCAATAATTAATTGCATAAAAGTTAT

GTAAAGTGAGTTTAATTAGGATTAGAGAGATCTTTTAAAGTTTTTCTCTCTT

TTCTCCTTGTTGTAATCCAGTGTATTTAATCAAATCTCAGATGGAGTTCAAA

TTTCGAGATCATGTTGTTTGTTTTCCAACAAATCTAATTTACAAGAAGAGT

AGATTATTGATTAGTGCTTATAACTCTTTTGCAGTCAAGTTTCTGGATCATA

GACTTATTATATAAGTTATCGTACAAACATACCTTTATATATGTACTTACAG

TACTATTAGTAGCCAACTATCTTAACCCAAATTTTAGCTACCTAAAATATCT

AAAAGGCAACAAATGAAGTAAGATCCATAGTCGATTGATCTAAAGGCAAC

AATTTTCTGGATGCCTACTCGATGGATCTAAAAGGTAACAATGTTCACATTT

TCAAGATTACTTACACTTATGATAATGAGATTAGCACCCAGCTTTCTTGTA

CAAAGTTGGCATTATAAGAAAGCATTGCTTATCAATTTGTTGCAACGAA

CAGGTCACTATCAGTCAAAATAAAATCATTATTTG

AT4G01130ter11 (3'- downstream region; +2176 to +2675; SEQ ID NO: 104)
CAAATAATGATTTTATTTTGACTGATAGTGACCTGTTCGTTGCAACAAA

TTGATGAGCAATGCTTTTTATAATGCCAACTTTGTATAATAAAGTTGTA

CTTTGTATAAGATCATTAGTTGTTAATTTTTTAAATATGAATTTCTAAACTAT

CCACCAACTAAGCATGTTGTGACAAGCAAAAGTATATAGATAATTAGATAT

TATATGTATATGTTTAAAATTGCGTAATATGCTTTACAGGTCGATTGTTCTC

CTAATCATTTGATTCTTCTTAATTTATTGGATTACGAAATGACATTTCTTTGT

CACCTTTTTCGTGCATATCAGATTTGTTTAAAGTTTACGTGACGAATGACGA

TTGATCTTTTATCTTGTTGTGCCGCCGTATTTTGTATGGACATTACTTGTAAT

ACTATATATATCAGCTATGCGTTAACTATACTCATCAAATACCACATATGAT

TTATTATATCAAAGTACTTATTAATAAATAATTAAATTAACCTTATATTCAA

TTGCACTTGGGTGAGAAAGCCGTTAGAAAAAACTCCCGCTATAGAAGAAAT

GTGGTAGATTTGAACCGAAATTAAATATTTTCACCCAGCTTTCTTGTACAA

AGTTGGCATTATAAGAAAGCATTGCTTATCAATTTGTTGCAACGAACAG

GTCACTATCAGTCAAAATAAAATCATTATTTG

AT5G19240ter12 (3'- downstream region; +854 to +1353; SEQ ID NO: 105)
CAAATAATGATTTTATTTTGACTGATAGTGACCTGTTCGTTGCAACAAA

TTGATGAGCAATGCTTTTTATAATGCCAACTTTGTATAATAAAGTTGTA
```

```
TATGACGTGATTATGGTGAAATTTTTAATAAATTCGTGTGGCAATCAATTAA

AGAGAGAATAACAATATATTAATTGGAGCAAATCGCCTTTCTTATAAAGTT

TCCTCTTACCAAGTGTGTGTGAGTTGAGTAAATAAGAAAACCCTTTTATAAG

CCCGCAAAACCCATACAAACAGGAATGAACCGCCAATGTCCCTAAGAATAT

GGACTCCTAGCAGCTAAACGTGCCTAGTCAAGCCCCGTGGAGCCGCGTAGG

CAGAGAGGGGGAGATAAAAGAAGAGGAGAGTGTTGCATGGAATTACAT

TTTAGTTGATTTTTGGAAGGATTTGGTCCACCCTGTCTTCATCAAGTCACAT

ACACCACCAGTTATCATTTTGTATTCATAATTTTAAGAAATTGATCTTTTGTC

TTGATCTGTCTTGCAATGACATATCCTACTGGAGACTTGTATCAGGAAAATT

CAAAATTGCCGGAGAAAATAGTGTTAAGCTTTTTTTCACCCAGCTTTCTTG

TACAAAGTTGGCATTATAAGAAAGCATTGCTTATCAATTTGTTGCAACG

AACAGGTCACTATCAGTCAAAATAAAATCATTATTTG
```

AT5G58120ter13 (3'- downstream region; +3437 to +3698; SEQ ID NO: 106)
```
CAAATAATGATTTTATTTTGACTGATAGTGACCTGTTCGTTGCAACAAA

TTGATGAGCAATGCTTTTTTATAATGCCAACTTTGTATAATAAAGTTGTA

AAAGAAAAAGAAAAATGAATCATCAGTCTCTTTTGATCGCTTCATGAGGTT

TTTTATTGTATACGAAACCTTCAGAAAAAATACATGTATCCATGCTTGTTGT

TGACGTCAAAGTTCAGTTCATCAAAAAGATCTTATCTAATGAGAAATGCTTT

TTATAGAAGTGTACCTTAAAACCTTGAATTAAAAAAAACATTGTATTGTGTT

AAGCACAAAAACTGTGGAGGGATACATAATTTGAAGAGCCTCTGATAGTAT

TAACCACCCAGCTTTCTTGTACAAAGTTGGCATTATAAGAAAGCATTGC

TTATCAATTTGTTGCAACGAACAGGTCACTATCAGTCAAAATAAAATCA

TTATTTG
```

AT3G47340ter14 (3'- downstream region; +3109 to +3608; SEQ ID NO: 107)
```
CAAATAATGATTTTATTTTGACTGATAGTGACCTGTTCGTTGCAACAAA

TTGATGAGCAATGCTTTTTTATAATGCCAACTTTGTATAATAAAGTTGTA

CTTCGAAGGAGAAATGGATGAAATATGTGTTATATCTTCCCAATGGGTGAA

GTGTTTTGTATGATTTTAAAAATAAGAATGTGATCCTTTTTTTTTCCTATGAA

GATCTGAATGTATAATCTATCTTGTAAAAATTTGTTTCTTTGTAAGATTTGA

ATGTACCGCTTTTACGTAGATCGATGTACATCAATCTTATAAGTTTCAATTA

TGTATTATATTATGTCGATTTGCCAAAAATAAATCTAAAACCTCAAAAATA

AATCTGGTTTTAGATACTTGTATATAGTACTAACTCGATGAAAAAATGATTT

TTTTTTTGTTACTGAATCTGAAATATAATTATAAAATAAAAATACTAATTAT

TAATAAATCAATTTACCAAAAATTTTAAATTTTGATAACAAAAAATTAAAT

CTAGTCAATTTTTAAAAGTTCTTTTTTGATATTTCAAATATCCGAATTCGAA

ATAATTCCAACCGAATTCATAGTCGACTCAAACACACCCAGCTTTCTTGTA

CAAAGTTGGCATTATAAGAAAGCATTGCTTATCAATTTGTTGCAACGAA

CAGGTCACTATCAGTCAAAATAAAATCATTATTTG
```

Encoding 3xFLAG protein tag (SEQ ID NO: 108)
```
GATTCATAGTGACTGGATATGTTGTGTTTTACAGTATTATGTAGTCTGTT

TTTTATGCAAAATCTAATTTAATATATTGATATTTATATCATTTTACGTT

TCTCGTTCAACTTTTCTATACAAAGTTGTAATGGACTACAAAGACCATGA
```

-continued
CGGTGATTATAAAGATCATGACATCGATTACAAGGATGACGATGACAAGTG

AACAACTTTGTATAATAAAGTTGAACGAGAAACGTAAAATGATATAAAT

ATCAATATATTAAATTAGATTTTGCATAAAAAACAGACTACATAATACT

GTAAAACACAACATATCCAGTCACTATGAATC

Encoding V5 protein tag (Codon optimized; SEQ ID NO: 109)
GATTCATAGTGACTGGATATGTTGTGTTTTACAGTATTATGTAGTCTGTT

TTTTATGCAAAATCTAATTTAATATATTGATATTTATATCATTTTACGTT

TCTCGTTCAACTTTTCTATACAAAGTTGTAATGGAAGGaAAGCCTATtCCT

AAtCCTCTtCTtGGaCTtGATTCTACtTGAACAACTTTGTATAATAAAGTTGAA

CGAGAAACGTAAAATGATATAAATATCAATATATTAAATTAGATTTTGC

ATAAAAAACAGACTACATAATACTGTAAAACACAACATATCCAGTCACT

ATGAATC

Encoding 3xHA protein tag (Codon optimized; SEQ ID NO: 110)
GATTCATAGTGACTGGATATGTTGTGTTTTACAGTATTATGTAGTCTGTT

TTTTATGCAAAATCTAATTTAATATATTGATATTTATATCATTTTACGTT

TCTCGTTCAACTTTTCTATACAAAGTTGTAATGggacttATTAACATCTTTTA

CCCATACGATGTTCCTgatTATgctggaTACCCATACGATGTTCCTgatTATgctGGA tctTACCCATACGATGTTCCTgatTATgctGCTCAGTGCtctTAGACAACTTTGTAT

AATAAAGTTGAACGAGAAACGTAAAATGATATAAATATCAATATATTAA

ATTAGATTTTGCATAAAAAACAGACTACATAATACTGTAAAACACAACA

TATCCAGTCACTATGAATC

Encoding 4xcMyc protein tag (Codon optimized; SEQ ID NO: 111)
GATTCATAGTGACTGGATATGTTGTGTTTTACAGTATTATGTAGTCTGTT

TTTTATGCAAAATCTAATTTAATATATTGATATTTATATCATTTTACGTT

TCTCGTTCAACTTTTCTATACAAAGTTGTAATGGAACAAAAGCTtATtTCtG

AGGAAGAtcttAACGGTGAACAAAAGCTtATtTCtGAGGAAGAtcttAACGGActtgat ggaGAACAAAAGCTtATtTCtGAGGAAGAtcttAACggaGAACAAAAGCTtATtTCtG AGGAAGAtcttAACGGTtctGCTTAGACAACTTTGTATAATAAAGTTGAACGA

GAAACGTAAAATGATATAAATATCAATATATTAAATTAGATTTTGCATA

AAAAACAGACTACATAATACTGTAAAACACAACATATCCAGTCACTATG

AATC

Encoding AU1 protein tag (SEQ ID NO: 112)
GATTCATAGTGACTGGATATGTTGTGTTTTACAGTATTATGTAGTCTGTT

TTTTATGCAAAATCTAATTTAATATATTGATATTTATATCATTTTACGTT

TCTCGTTCAACTTTTCTATACAAAGTTGTAATGGATACTTATAGATATATT

TGAACAACTTTGTATAATAAAGTTGAACGAGAAACGTAAAATGATATAA

ATATCAATATATTAAATTAGATTTTGCATAAAAAACAGACTACATAATA

CTGTAAAACACAACATATCCAGTCACTATGAATC

Encoding AcV5 protein tag (Codon optimized; SEQ ID NO: 113)
GATTCATAGTGACTGGATATGTTGTGTTTTACAGTATTATGTAGTCTGTT

TTTTATGCAAAATCTAATTTAATATATTGATATTTATATCATTTTACGTT

TCTCGTTCAACTTTTCTATACAAAGTTGTAATGTCTTGGAAAGATgcttctGG aTGGTCTtgaACAACTTTGTATAATAAAGTTGAACGAGAAACGTAAAATGA

```
TATAAATATCAATATATTAAATTAGATTTTGCATAAAAAACAGACTACA

TAATACTGTAAAACACAACATATCCAGTCACTATGAATC
```

Encoding Strep-tagII protein tag (Codon optimized; SEQ ID NO: 114)
```
GATTCATAGTGACTGGATATGTTGTGTTTTACAGTATTATGTAGTCTGTT

TTTTATGCAAAATCTAATTTAATATATTGATATTTATATCATTTTACGTT

TCTCGTTCAACTTTTCTATACAAAGTTGTAATGGCTGGAtcTACTGGAGCT

TCTTGGTCTCATCCTCAATTTGAAAAGGGAGGAGGTTCTGGAGGTGGATCT

GGTGGAGGATCATGGTCTCATCCACAGTTCGAAAAGGGAGCTGGATCTAGG

CCTATTTGAACAACTTTGTATAATAAAGTTGAACGAGAAACGTAAAATG

ATATAAATATCAATATATTAAATTAGATTTTGCATAAAAAACAGACTAC

ATAATACTGTAAAACACAACATATCCAGTCACTATGAATC
```

Encoding 6xHis protein tag (Codon optimized; SEQ ID NO: 115)
```
GATTCATAGTGACTGGATATGTTGTGTTTTACAGTATTATGTAGTCTGTT

TTTTATGCAAAATCTAATTTAATATATTGATATTTATATCATTTTACGTT

TCTCGTTCAACTTTTCTATACAAAGTTGTAATGtctCATCATCATCATCATC

ATGCTTAGACAACTTTGTATAATAAAGTTGAACGAGAAACGTAAAATGA

TATAAATATCAATATATTAAATTAGATTTTGCATAAAAAACAGACTACA

TAATACTGTAAAACACAACATATCCAGTCACTATGAATC
```

Encoding T7 protein tag (Codon optimized; SEQ ID NO: 116)
```
GATTCATAGTGACTGGATATGTTGTGTTTTACAGTATTATGTAGTCTGTT

TTTTATGCAAAATCTAATTTAATATATTGATATTTATATCATTTTACGTT

TCTCGTTCAACTTTTCTATACAAAGTTGTAATGGCTtctATGACTGGTGGAC

AGCAAATGGGTGCTTAGACAACTTTGTATAATAAAGTTGAACGAGAAAC

GTAAAATGATATAAATATCAATATATTAAATTAGATTTTGCATAAAAAA

CAGACTACATAATACTGTAAAACACAACATATCCAGTCACTATGAATC
```

Expression Analysis by Histochemical GUS Staining in the Transgenic $T_1$ Arabidopsis Arabidopsis thaliana (Col-0) was grown in a growth chamber under 12 h/12 h (light, 135 μmol m$^{-2}$ s$^{-1}$/dark) cycles at 23° C./21° C. (day/night). The constructs of AT3G59350pro1::GUS/LUC, AT4G32340pro2::GUS/LUC, AT5G23240pro3::GUS/LUC, AT5G44050pro4::GUS/LUC, AT4G04330pro5::GUS/LUC, AT4G23290pro6::GUS/LUC, AT1G07180pro7::GUS/LUC, AT1G65490pro8::GUS/LUC, AT1G21670pro9::GUS/LUC, AT2G17450pro10::GUS/LUC, AT4G01130pro11::GUS/LUC, AT5G19240pro12::GUS/LUC, AT5G58120pro13::GUS/LUC, and AT3G47340pro14::GUS/LUC were introduced into Agrobacterium tumefaciens GV3101 and 4-week-old plants were transformed using the Agrobactrium-mediated floral dipping method (Zhang et al, 2006, Nature Protocol 1: 641-646). Seeds were harvested and screened on ½ Murashige and Skoog (MS) medium containing 50 μg mL$^{-1}$ kanamycin. Surviving transgenic plants were transferred to new ½ MS medium and soil and were grown for 30 and 60 days, respectively. Both the soil- or MS medium-grown transgenic $T_1$ plants were used to analyze tissue-specific expression by histochemical staining of GUS activity in the different stages of Arabidopsis growth and development.

Histochemical GUS assays were based upon methods described in Jefferson et al. (EMBO J. 6: 3901-3907, 1987) with the following modifications. Plant tissues were submerged in 1 mg ml$^{-1}$ X-GlucA solution (5-bromo-4-chloro-3-indolyl glucuronide, X871, Phyto Technology Lab. Overland Park, Kans., USA) in 50 mM sodium phosphate buffer [(pH 7.0), 4 mM EDTA, 1 mM K$_4$Fe(CN)$_6$, 1 mM K$_3$Fe(CN)$_6$, and 0.1% Triton X-100] and vacuum infiltrated for 20 mM and then incubated overnight at 37° C. in the dark. Tissue was dehydrated in a series of increasing concentrations of ethanol (70%, 80%, 90%, and 95% v/v) over 2 days. Images were photographed using a zoom stereomicroscope (SMZ800, Nikon Instruments Inc., Melville, N.Y., USA).

Construction of Position, Adaptor, and Carrier Vectors

For every position vector (also referred to as position binary vector), the gypsy barrier insulator (396 bp) with SbfI and XbaI was synthesized by DNA 2.0 and used for preventing heterochromatin-mediated gene silencing and interference between adjacent transcription units (She et al., 2010, Genetics 185: 1141-1150). One copy of the predigested gypsy insulator was cloned into the SbfI and XbaI sites of pGWB401 vector (Nakagawa et al., 2007, Bioscience Biotechnology, and Biochemistry 71: 2095-2100), named pGWB401 plus gypsy-F. Then, the gypsy insulator was amplified by polymerase chain reaction (PCR) to generate a product with a 5' AscI and terminating with a 3' SacI site. The reverse complement sequence of the gypsy insulator was replaced with the Nopaline synthase (Nos) terminator between SacI and AscI sites in the pGWB401 plus gypsy-F vector. The resulting plasmid contained two copies of gypsy barrier insulator oriented in different directions and named pGWB401 plus gypsy.

For reliable construction of large gene circuits, homing enzyme I-sceI (Mour et al., 2003, Journal of Molecular Biology 334: 685-695), Multisite Gateway (Invitrogen, Carlsbad, Calif., USA), and Gibson isothermal assembly (Gibson et al., 2009, Nature Methods 6: 343-345) methods were used as described in detail by Guye et al. (Nucleic Acids Research 41: e1562013). To insert homing enzyme I-sceI and unique sequences (UNS) at the 3'-downstream of reverse complementary gypsy insulator in the pGWB401 plus gypsy vector, multiple cloning sites of AscI, PacI, AseI, KpnI, SpeI, and AscI were generated. Two complementary oligonucleotides were incubated in the annealing buffer (10 mM Tris, pH7.5, 50 mM NaCl, and 1 mM EDTA) using the thermocycler at 95° C. for 2 mM and then gradually cool to 25° C. for 45 mM. Both the double-strand oligonucleotides containing the multiple cloning sites and the pGWB401 plus gypsy were digested by AscI restriction enzyme. Then, the linearized pGWB401 plus gypsy DNA fragment was dephosphorylated by alkaline phosphatase, calf intestinal (CIP, M0290, NEB, Ipswich, Mass., USA) and ligated with the predigested oligonucleotides containing the multiple cloning sites. Next, synthesized DNA sequences of I-sceI-UNS 1 to 11 were cloned using HindIII and SfbI sites, which are positioned at the 5'-upstream region of the gypsy insulator in the pGWB401 plus gypsy vector. After DNA sequencing verification of the I-sceI-UNS 1 to 11 inserts at 5'-upstream region of the pGWB401 plus gypsy vector, the other synthesized DNA sequences of I-sceI-UNS 2 to 12 were inserted in the 3'-downstream region of the reverse complement sequence of gypsy insulator using KpnI and SpeI sites. All synthesized DNA sequences of the UNS sequences are presented in Tables 1-5 below.

TABLE 1

A list of synthesized DNA sequences positioned in 5'-upstream region of position binary vectors

| Name | | HindIII | I-sceI (reverese complement) | | Unique sequences (1 to 11) | SbfI | | SEQ ID NO. |
|---|---|---|---|---|---|---|---|---|
| I-sceI-UNS1_upstream | 5'- | AAGCTT | ATTACCCTGTTATCCCTA | ACC | GGTTTACCGAGCTCTTATTGGTT TTCAAACTTCATTGACTGTGCC | CCTGCAGG | -3' | 10 |
| I-sceI-UNS2_upstream | 5'- | AAGCTT | ATTACCCTGTTATCCCTA | ACC | GGTGCGTTTTTATGCTTGTAGTA TTGTATAATGTTTTTAAGATCC | CCTGCAGG | -3' | 11 |
| I-sceI-UNS3_upstream | 5'- | AAGCTT | ATTACCCTGTTATCCCTA | ACC | GGTCTAATACCCAATCTCTCGTC TTATCCAGATGTTTTATACGCC | CCTGCAGG | -3' | 12 |
| I-sceI-UNS4_upstream | 5'- | AAGCTT | ATTACCCTGTTATCCCTA | ACC | GGTGAATTCCCTTATGTGAGTGT AAAAGGCAGGCGAGTTTGTCCC | CCTGCAGG | -3' | 13 |
| I-sceI-UNS5_upstream | 5'- | AAGCTT | ATTACCCTGTTATCCCTA | ACC | GGTTGCTTGCAAAAGCAGTAATT GGAAAGCACTCTCAAAGAATCC | CCTGCAGG | -3' | 14 |
| I-sceI-UNS6_upstream | 5'- | AAGCTT | ATTACCCTGTTATCCCTA | ACC | GGTAGATAAGTTGATTTAGCCAT AAAATATTGTTTCCGTGACCCC | CCTGCAGG | -3' | 117 |
| I-sceI-UNS7_upstream | 5'- | AAGCTT | ATTACCCTGTTATCCCTA | ACC | GGTTCTGAGTCACGGCTTCATTG GCATTCCGTACAACGAACGTCC | CCTGCAGG | -3' | 118 |
| I-sceI-UNS8_upstream | 5'- | AAGCTT | ATTACCCTGTTATCCCTA | ACC | GGTCCTCAGAGAGCCTATAGCGG TAAAACAACACCATGCATCCCC | CCTGCAGG | -3' | 119 |
| I-sceI-UNS9_upstream | 5'- | AAGCTT | ATTACCCTGTTATCCCTA | ACC | GGTCGCAGTCGCTTCCTGTAAAT AGAGCATTAAATTCCATAGTCC | CCTGCAGG | -3' | 120 |
| I-sceI-UNS10_upstream | 5'- | AAGCTT | ATTACCCTGTTATCCCTA | ACC | GGTACTTAATCGAAAAAAAAACA GACAGCCATGTGCTCTTCGGCC | CCTGCAGG | -3' | 121 |
| I-sceI-UNS11_upstream | 5'- | AAGCTT | ATTACCCTGTTATCCCTA | ACC | GGTGGACATGATTATGGAACACA CACACGCTAGCCGCCCAGTTCC | CCTGCAGG | -3' | 122 |

TABLE 2

A list of synthesized DNA sequences positioned in 3'-downstream region of position vectors

| Name | | KpnI | Unique sequences (2 to 12) | PacI | I-sceI | SpeI | | SEQ ID NO: |
|---|---|---|---|---|---|---|---|---|
| I-sceI-UNS2_downstream | 5'- | GGTACC | GGTGCGTTTTTATGCTTGTAGTA TTGTATAATGTTTTTAAGATCC | TTAATTAA | TAGGGATAACAGGGTAAT | ACTAGT | -3' | 123 |
| I-sceI-UNS3_downstream | 5'- | GGTACC | GGTCTAATACCCAATCTCTCGTC TTATCCAGATGTTTTATACGCC | TTAATTAA | TAGGGATAACAGGGTAAT | ACTAGT | -3' | 124 |
| I-sceI-UNS4_downstream | 5'- | GGTACC | GGTGAATTCCCTTATGTGAGTGT AAAAGGCAGGCGAGTTTGTCCC | TTAATTAA | TAGGGATAACAGGGTAAT | ACTAGT | -3' | 125 |

TABLE 2-continued

A list of synthesized DNA sequences positioned
in 3'-downstream region of position vectors

| Name | KpnI | Unique sequences (2 to 12) | PacI | I-sceI | SpeI | SEQ ID NO: |
|---|---|---|---|---|---|---|
| I-sceI-UNS5_downstream | 5'- GGTACC | GGTTGCTTGCAAAAGCAGTAATT GGAAAGCACTCTCAAAGAATCC | TTAATTAA | TAGGGATAACAGGGTAAT | ACTAGT -3' | 126 |
| I-sceI-UNS6_downstream | 5'- GGTACC | GGTAGATAAGTTGATTTAGCCAT AAAATATTGTTTCCGTGACCCC | TTAATTAA | TAGGGATAACAGGGTAAT | ACTAGT -3' | 127 |
| I-sceI-UNS7_downstream | 5'- GGTACC | GGTTCTGAGTCACGGCTTCATTG GCATTCCGTACAACGAACGTCC | TTAATTAA | TAGGGATAACAGGGTAAT | ACTAGT -3' | 128 |
| I-sceI-UNS8_downstream | 5'- GGTACC | GGTCCTCAGAGAGCCTATAGCGG TAAAACAACACCATGCATCCCC | TTAATTAA | TAGGGATAACAGGGTAAT | ACTAGT -3' | 129 |
| I-sceI-UNS9_downstream | 5'- GGTACC | GGTCGCAGTCGCTTCCTGTAAAT AGAGCATTAAATTCCATAGTCC | TTAATTAA | TAGGGATAACAGGGTAAT | ACTAGT -3' | 130 |
| I-sceI-UNS10_downstream | 5'- GGTACC | GGTACTTAATCGAAAAAAAACA GACAGCCATGTGCTCTTCGGCC | TTAATTAA | TAGGGATAACAGGGTAAT | ACTAGT -3' | 131 |
| I-sceI-UNS11_downstream | 5'- GGTACC | GGTGGACATGATTATGGAACACA CACACGCTAGCCGCCCAGTTCC | TTAATTAA | TAGGGATAACAGGGTAAT | ACTAGT -3' | 132 |
| I-sceI-UNS12_downstream | 5'- GGTACC | GGTGAGCCCAAACAGCGAAATAC CTGAGCGAACAAATACTACTCC | TTAATTAA | TAGGGATAACAGGGTAAT | ACTAGT -3' | 133 |

TABLE 3

A list of synthesized DNA sequences
positioned in 5'-upstream region of adaptor vectors

| Name | HindIII | Unique sequences (2 to 12) | PacI | Unique sequences 2 | I-sceI | SacI | SEQ ID NO |
|---|---|---|---|---|---|---|---|
| UNS2-UNS2-IsceI_upstream | AAG CTT | GGTGCGTTTTTATGCTTGTAGTA TTGTATAATGTTTTTAAGATCC | TTAATTAA | GGTGCGTTTTTATGCTTGTA GTATTGTATAATGTTTTTAA GATCC | TAGGGATAA CAGGGTAAT | GAGCTC | 134 |
| UNS3-UNS2-IsceI_upstream | AAG CTT | GGTCTAATACCCAATCTCTCGTC TTATCCAGATGTTTTATACGCC | TTAATTAA | GGTGCGTTTTTATGCTTGTA GTATTGTATAATGTTTTTAA GATCC | TAGGGATAA CAGGGTAAT | GAGCTC | 135 |
| UNS4-UNS2-IsceI_upstream | AAG CTT | GGTGAATTCCCTTATGTGAGTGT AAAAGGCAGGCGAGTTTGTCCC | TTAATTAA | GGTGCGTTTTTATGCTTGTA GTATTGTATAATGTTTTTAA GATCC | TAGGGATAA CAGGGTAAT | GAGCTC | 136 |
| UNS5-UNS2-IsceI_upstream | AAG CTT | GGTTGCTTGCAAAAGCAGTAATT GGAAAGCACTCTCAAAGAATCC | TTAATTAA | GGTGCGTTTTTATGCTTGTA GTATTGTATAATGTTTTTAA GATCC | TAGGGATAA CAGGGTAAT | GAGCTC | 137 |
| UNS6-UNS2-IsceI_upstream | AAG CTT | GGTAGATAAGTTGATTTAGCCAT AAAATATTGTTTCCGTGACCCC | TTAATTAA | GGTGCGTTTTTATGCTTGTA GTATTGTATAATGTTTTTAA GATCC | TAGGGATAA CAGGGTAAT | GAGCTC | 138 |
| UNS7-UNS2-IsceI_upstream | AAG CTT | GGTTCTGAGTCACGGCTTCATTG GCATTCCGTACAACGAACGTCC | TTAATTAA | GGTGCGTTTTTATGCTTGTA GTATTGTATAATGTTTTTAA GATCC | TAGGGATAA CAGGGTAAT | GAGCTC | 139 |
| UNS8-UNS2-IsceI_upstream | AAG CTT | GGTCCTCAGAGAGCCTATAGCGG TAAAACAACACCATGCATCCCC | TTAATTAA | GGTGCGTTTTTATGCTTGTA GTATTGTATAATGTTTTTAA GATCC | TAGGGATAA CAGGGTAAT | GAGCTC | 140 |
| UNS9-UNS2-IsceI_upstream | AAG CTT | GGTCGCAGTCGCTTCCTGTAAAT AGAGCATTAAATTCCATAGTCC | TTAATTAA | GGTGCGTTTTTATGCTTGTA GTATTGTATAATGTTTTTAA GATCC | TAGGGATAA CAGGGTAAT | GAGCTC | 141 |
| UNS10-UNS2-IsceI_upstream | AAG CTT | GGTACTTAATCGAAAAAAAACA GACAGCCATGTGCTCTTCGGCC | TTAATTAA | GGTGCGTTTTTATGCTTGTA GTATTGTATAATGTTTTTAA GATCC | TAGGGATAA CAGGGTAAT | GAGCTC | 142 |
| UNS11-UNS2-IsceI_upstream | AAG CTT | GGTGGACATGATTATGGAACACA CACACGCTAGCCGCCCAGTTCC | TTAATTAA | GGTGCGTTTTTATGCTTGTA GTATTGTATAATGTTTTTAA GATCC | TAGGGATAA CAGGGTAAT | GAGCTC | 143 |

TABLE 3-continued

A list of synthesized DNA sequences
positioned in 5'-upstream region of adaptor vectors

| Name | HindIII | Unique sequences (2 to 12) | PacI | Unique sequences 2 | I-sceI | SacI | SEQ ID NO |
|---|---|---|---|---|---|---|---|
| UNS12-UNS2-IsceI_upstream | AAG CTT | GGTGAGCCCAAACAGCGAAATAC CTGAGCGAACAAATACTACTCC | TTAATTAA | GGTGCGTTTTTATGCTTGTA GTATTGTATAATGTTTTTAA GATCC | TAGGGATAA CAGGGTAAT | GAGCTC | 144 |

TABLE 4

A synthesized DNA sequences positioned
in 3'-downstream region of adaptor vectors

| Name | NotI | Unique sequence X | XbaI | SEQ ID NO. |
|---|---|---|---|---|
| UNSx | GCGGCCGC | GGTGCGTTTTTATGCTT GTAGTATTGTATAATGT TTTTAAGATCC | TCTAGA | 145 |

TABLE 5

A synthesized DNA sequences
positioned in carrier vector

| Name | HindIII | I-sceI | Unique sequence 1 | PacI | Unique sequence X | EcoRI | SEQ ID NO. |
|---|---|---|---|---|---|---|---|
| I-sceI-UNS1-PacI-UNSx | AAGCTT | TAGGGA TAACAG GGTAAT | GGTTTACCGAGC TCTTATTGGTTT TCAAACTTCATT GACTGTGCC | TTAA TTAA | GGTATCACTAGT ATTACAGAGGTA AGTTATAACAGT CGCCTAACC | GAATT C | 146 |

For the creation of the 33 adaptor vectors containing kanamycin, hygromycin, or BASTA resistance cassettes, the kanamycin resistance cassette was retrieved from pGWB401 vector by EcoRI digestion and hygromycin and BASTA resistance cassettes were PCR-amplified using the hygromycin and the BASTA specific primer pairs. Two plasmids of pGWB501 (Nakagawa et al., 2007, Bioscience Biotechnology, and Biochemistry 71: 2095-2100) and pCAMBIA3301 (see cambia.org/daisy/cambia/home.html) were used as DNA templates to amplify both the hygromycin and BASTA cassettes, respectively. Predigested kanamycin cassette (1,763 bp) and the TOPO vector backbone (3,501 bp) were recombined with each other using T4 DNA ligase (Takara Bio Inc., Otsu, Shiga, Japan). Each of PCR-amplified hygromycin (2,255 bp) and BASTA (1,684 bp) cassettes was digested by SpeI and NotI restriction enzyme sites and ligated with the TOPO vector, respectively.

Next, synthesized DNA sequence of NotI-UNSx-XbaI was inserted at 3'-downstream region of the plant selectable marker using NotI and XbaI sites and then, 11 DNA sequences of HindIII-UNS (2 to 12)-PacI-UNS2-I-sceI-SacI were cloned at the 5'-upstream region of the plant selectable marker using HindIII and XbaI sites. A total of 33 adaptor vectors containing the three different plant selectable markers and UNSes such that the Adaptor-Kan (2 to 12), Adaptor-Hyg (2 to 12), and Adaptor-BASTA (2 to 12) were constructed to link between position binary vectors and a carrier vector via Gibson isothermal assembly.

For a carrier vector, the pGWB401 vector was digested using HindIII and EcoRI to remove the DNA fragment of attR1-CAT-ccdB-attR2-kanamycin resistance cassette (3,974 bp) and the DNA sequence of HindIII-I-sceI-UNS1-PacI-UNSx-EcoRI was inserted into the predigested pGWB401 vector. Inserted sequences including I-sceI, UNSes, and gypsy insulator in the 11 position binary vectors, 33 adaptor vectors and, 1 carrier vector were verified by DNA sequencing (Nevada Genomics Center, Reno, Nev., USA). All sequences of position binary vectors, adaptor vectors, and carrier vector are presented in SEQ ID NOS: 15-59.

Part Vector of CAM Genes and Promoters

To construct the part vectors of CAM genes and promoters, the Gateway BP reaction was performed according to the manufacturer's protocol (Invitrogen, Carlsbad, Calif., USA). The full-length coding sequences of nine CAM genes were amplified with attB5 site in the forward primers and attB4 site in the reverse primers (Tables 6 and 7).

TABLE 6

A list of primers for CAM
gene cloning in ice plant

| Name (SEQ ID NO.) | Forward primer (5' to 3') | Reverse primer (5' to 3') |
|---|---|---|
| McBca2 (147 and 148) | ATGACAGGAGGCTT TAGGAAATG | TTATACTGCGGTAG AAGGTGAGAG |
| McPpc1 (149 and 150) | ATGTCGACTGTGAA GCTAGATAGG | CTAACCAGTGTTCT GCAGACCA |
| McPpck (151 and 152) | ATGTGTGAGAGCTT CAAGAGAGAA | TTACATGTTGGCCA ATCCTC |
| McNAD-Mdh2 (153 and 154) | ATGGCCGTTGAACC TCTTC | TTAAGTCAGGCATG AGTAGGCC |
| McNADP-ME3 (155 and 156) | ATGGGTGGTAGCAA TGCATT | TCAACGGAAACTCC GGTAAG |
| McPpdk1 (157 and 158) | ATGGCGTCAGCTTT CAAGG | TCAAACGACTTGAG CTGCTG |
| McPpdk-RP (159 and 160) | ATGTTAGCTTGTGC TAGCCTCG | CTAATAGCGCTTAG ATATTCTGGGC |
| McALMT4 (161 and 162) | ATGGCGGGGAAATT CGGATCACTGA | ATTTCTGAACTGAA GGGACACCATCAAC |

TABLE 6-continued

A list of primers for CAM gene cloning in ice plant

| Name (SEQ ID NO.) | Forward primer (5' to 3') | Reverse primer (5' to 3') |
|---|---|---|
| MctDT (163 and 164) | ATGAATCATAATCA CGATCCCAA | TCATGTATATCCCG AATTTGAATACA |

TABLE 7

A list of primers for CAM gene circuit

| Name (SEQ ID NO) | Primer sequence (5' to 3') |
|---|---|
| McBca2-attB5-Fwd (165) | GGGGACAACTTTGTATACAAAGTTG TAATGACAGGAGGCTTTAGGAAATGC A |
| McBca2-attB4-Rev (166) | GGGGACAACTTTGTATAGAAAAGTTG GGTTTACTGCGGTAGAAGGTGAGAGG CCA |
| McPpc1-attB5-Fwd (167) | GGGGACAACTTTGTATACAAAGTTG TAATGTCGACTGTGAAGCTAGATAGG C |
| McPpc1-attB4-Rev (168) | GGGGACAACTTTGTATAGAAAAGTTG GGTTACCAGTGTTCTGCAGACCAGCA GCA |
| McPpck-attB5-Fwd (169) | GGGGACAACTTTGTATACAAAGTTG TAATGTGTGAGAGCTTCAAGAGAGAA T |
| McPpck-attB4-Rev (170) | GGGGACAACTTTGTATAGAAAAGTTG GGTTCATGTTGGCCAATCCTCCACTG GTT |
| McNAD-Mdh2-attB5-Fwd (171) | GGGGACAACTTTGTATACAAAGTTG TAATGGCCGTTGAACCTCTTCGCGTT C |
| McNAD-Mdh2-attB4-Rev (172) | GGGGACAACTTTGTATAGAAAAGTTG GGTTAGTCAGGCATGAGTAGGCCAAT GTC |
| McNADP-ME3-attB5-Fwd (173) | GGGGACAACTTTGTATACAAAGTTG TAATGGGTGGTAGCAATGCATTGAAT G |
| McNADP-ME3-attB4-Rev (174) | GGGGACAACTTTGTATAGAAAAGTTG GGTTACGGAAACTCCGGTAAGTAGGG TTG |
| McPpdk1-attB5-Fwd (175) | GGGGACAACTTTGTATACAAAGTTG TAATGGCGTCAGCTTTCAAGGGGATC T |
| McPpdk1-attB4-Rev (176) | GGGGACAACTTTGTATAGAAAAGTTG GGTTAACGACTTGAGCTGCTGCCAGC CTT |
| McPpdk-RP-attB5-Fwd (177) | GGGGACAACTTTGTATACAAAGTTG TAATGTTAGCTTGTGCTAGCCTCGGC C |
| McPpdk-RP-attB4-Rev (178) | GGGGACAACTTTGTATAGAAAAGTTG GGTTATAGCGCTTAGATATTCTGGGC ATC |
| McALMT4-attB5-Fwd (179) | GGGGACAACTTTGTATACAAAGTTG TAATGGCGGGGAAATTCGGATCACTG A |

TABLE 7-continued

A list of primers for CAM gene circuit

| Name (SEQ ID NO) | Primer sequence (5' to 3') |
|---|---|
| McALMT4-attB4-Rev (180) | GGGGACAACTTTGTATAGAAAAGTTG GGTTATTTCTGAACTGAAGGGACACC ATC |
| MctDT-attB5-Fwd (181) | GGGGACAACTTTGTATACAAAGTTG TAATGAATCATAATCACGATCCCAAA A |
| MctDT-attB4-Rev (182) | GGGGACAACTTTGTATAGAAAAGTTG GGTTTGTATATCCCGAATTTGAATAC AAA |
| AT3G59350pro1-attB1-Fwd (183) | GGGGACAAGTTTGTACAAAAAAGCAG GCTTAGATTTCTATCAATGAAAGTAG ACGT |
| AT3G59350pro1-attB5r-Rev (184) | GGGGACAACTTTGTATACAAAGTTG TAGTGAAAGACGGATCGAATAAATTT |
| AT4G32340pro2-attB1-Fwd (185) | GGGGACAAGTTTGTACAAAAAAGCAG GCTTATTCATTAAAAAAATATTTTTA TACT |
| AT4G32340pro2-attB5r-Rev (186) | GGGGACAACTTTGTATACAAAGTTG TTGTTAGTTCTTGTGGGGAATATTTC |
| AT5G23240pro3-attB1-Fwd (187) | GGGGACAAGTTTGTACAAAAAAGCAG GCTTACTGAAATTTAGTAGAGAAAAA TATA |
| AT5G23240pro3-attB5r-Rev (188) | GGGGACAACTTTGTATACAAAGTTG TATTTCCCCTTCTCTGTTTTGGAAG |
| AT5G44050pro4-attB1-Fwd (189) | GGGGACAAGTTTGTACAAAAAAGCAG GCTTACTCTTTCTAATTTCAGGTTAT AATT |
| AT5G44050pro4-attB5r-Rev (190) | GGGGACAACTTTGTATACAAAGTTG TCGCCGATCTTCAGTAAATTAACAAT |
| AT4G04330pro5-attB1-Fwd (191) | GGGGACAAGTTTGTACAAAAAAGCAG GCTTATTTTAAATATCTGTATTTTGC CTCC |
| AT4G04330pro5-attB5r-Rev (192) | GGGGACAACTTTGTATACAAAGTTG TAGAAATATTGGATGAAGAAAAATTG |
| AT4G23290pro6-attB1-Fwd (193) | GGGGACAAGTTTGTACAAAAAAGCAG GCTTAGAACAGATAAGTGAAGTTTCT CTGC |
| AT4G23290pro6-attB5r-Rev (194) | GGGGACAACTTTGTATACAAAGTTG TCGAGTTTGATTTTCTTGTTTAAAAC |
| AT1G07180pro7-attB1-Fwd (195) | GGGGACAAGTTTGTACAAAAAAGCAG GCTTATTAATAAATTAGTAATGAACA CCTA |
| AT1G07180pro7-attB5r-Rev (196) | GGGGACAACTTTGTATACAAAGTTG TGATTCTTTAGGTACTCTTCTTCAAT |
| AT1G65490pro8-attB1-Fwd (197) | GGGGACAAGTTTGTACAAAAAAGCAG GCTTAACCGCTTAATATCGTATGATT AGTA |
| AT1G65490pro8-attB5r-Rev (198) | GGGGACAACTTTGTATACAAAGTTG TTTCGTTCTTCGTTGCGTTTTTGGTC |
| AT1G21670pro9-attB1-Fwd (199) | GGGGACAAGTTTGTACAAAAAAGCAG GCTTAAGCTTATAGCGTAGAGATGAT TCAC |
| AT1G21670pro9-attB5r-Rev (200) | GGGGACAACTTTGTATACAAAGTTG TGGTGGACTCTTGTTTTGGGACTTGA |

TABLE 7-continued

A list of primers for CAM gene circuit

| Name (SEQ ID NO) | Primer sequence (5' to 3') |
|---|---|
| AT2G17450pro10-attB1-Fwd (201) | GGGGACAAGTTTGTACAAAAAAGCAGGCTTAAGTAAAGAGAATGATTATTGAGAAT |
| AT2G17450pro10-attB5r-Rev (202) | GGGGACAACTTTTGTATACAAAGTTGTTGCTTTTTGAGCTTTGGAGACTTTT |
| AT4G01130pro11-attB1-Fwd (203) | GGGGACAAGTTTGTACAAAAAAGCAGGCTTAAAAGAAGAGAGAGGAAGGAGAAGAG |
| AT4G01130pro11-attB5r-Rev (204) | GGGGACAACTTTTGTATACAAAGTTGTGTCTATCTCTGTGTGAACAAAATGT |
| AT5G19240pro12-attB1-Fwd (205) | GGGGACAAGTTTGTACAAAAAAGCAGGCTTAAAGTCATACAACATCAGTTTTTGTT |
| AT5G19240pro12-attB5r-Rev (206) | GGGGACAACTTTTGTATACAAAGTTGTTGATGCAGAGGCACTTTTAGCTTTA |
| AT5G58120pro13-attB1-Fwd (207) | GGGGACAAGTTTGTACAAAAAAGCAGGCTTAAAGTGTAGATTATTACAAGTATATA |
| AT5G58120pro13-attB5r-Rev (208) | GGGGACAACTTTTGTATACAAAGTTGTGGGGAAGAATCTTGAGTGGTTTAAA |
| AT3G47340pro14-attB1-Fwd (209) | GGGGACAAGTTTGTACAAAAAAGCAGGCTTAATTTCAATCATTTATAGCTGAAGGT |
| AT3G47340pro14-attB5r-Rev (210) | GGGGACAACTTTTGTATACAAAGTTGTGTTTTTTTTTGAAGAAAGTGAAAA |

The attB5 and attB5-flanked PCR products were purified and mixed with pDONR™ 221 P5-P4 and BP clonase II for 3 hours. For part vectors of promoters, AT3G59350pro1, AT1G65490pro8, AT5G23240pro3, AT4G01130pro11, AT5G44050pro4, AT1G07180pro7, AT1G21670pro9, AT4G23290pro6, and AT4G04330pro5 were PCR-amplified with an attB1 site in the forward primers and an attB5r site in the reverse primers and the purified PCR products were introduced into pDONR™ 221 P1-P5r by Gateway BP reaction. Recombinant part vectors of CAM genes and promoters were transformed into E. coli competent cells and verified by DNA sequencing (Nevada Genomics Center, Reno, Nev., USA).

Construction of CAM Gene Cassettes

Gateway LR reactions were performed according to the manufacturer's protocol (Invitrogen, Carlsbad, Calif., USA). Briefly, 5 fmol of each of part vectors containing gene, promoter, and protein tag were mixed with position binary vector and incubated in LR Clonase II Plus enzyme mix at 25° C. for 16 h. The reaction mixture was transformed into E. coli competent cells and each of the position binary vectors containing different CAM gene cassettes was verified by DNA sequencing (Nevada Genomics Center, Reno, Nev., USA). The sequences of position binary vectors containing each CAM gene cassette are presented as SEQ ID NOs: 60-68.

Construction CAM Gene Circuit

Nine position binary vectors containing each of the CAM gene cassette were digested in I-sceI (R0694, NEB Biolabs, MA, USA) restriction enzyme mix at 37° C. for 6 hours. Subsequently, the Adaptor-Hyg (no. 10) was digested by HindIII and XbaI and the carrier vector was digested by PacI. A total of nine CAM gene cassettes and predigested-adaptor vector and -carrier vector were purified using the QIAquick gel extraction kit and Gibson assembly using a Gibson Assembly® Ultra kit (SGI-DNA, La Jolla, Calif., USA) was performed according to the manufacturer's protocol. Recombinant CAM gene cassettes were used as the DNA template and the full-length coding sequences of 9 CAM genes were amplified by PCR to verify their proper assembly. The DNA sequence of the CAM gene circuit containing 9 gene cassettes is presented as SEQ ID NO: 69.

Example 2

Methods of Increasing CAM Activity

Figure 2A:
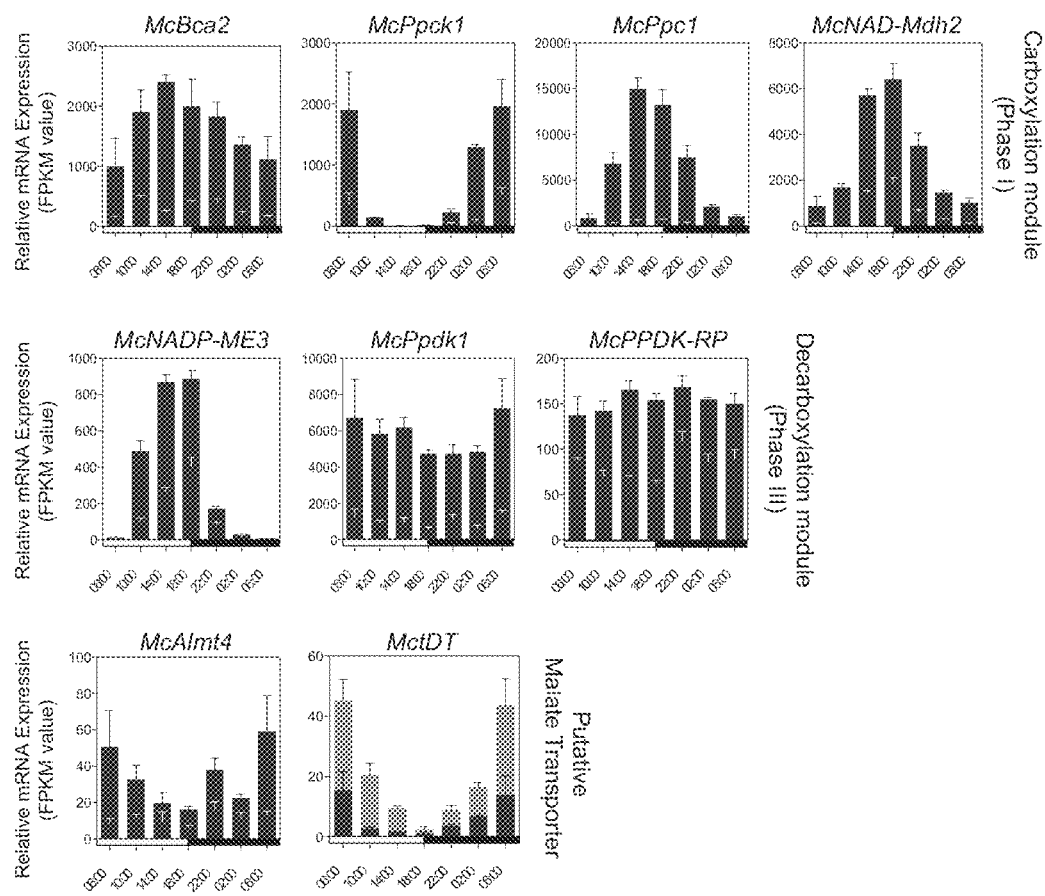
FIG. 2A provides a series of graphs illustrating mRNA expression patterns of selected core CAM genes in *Mesembryanthemum crystallinum*.

FIG. 2A illustrates mRNA expression patterns of selected core CAM genes in *Mesembryanthemum crystallinum*. The biochemical reactions for CAM are present in the mesophyll cells of all vascular plant species; however, only selected genes within these multi-gene families become recruited to carry out the enzymatic and transport functions required for CAM. To identify specific isogenes, RNA-sequencing (RNA-seq) was conducted in triplicate to define which genes were participating in CAM in the facultative CAM species *Mesembryanthemum crystallinum* under well-watered and water-deficit stress conditions. The averaged FPKM (fragments per kb of exon per million fragments mapped) values of three biological replicates were calculated from TMM (trimmed mean of M-values) normalized RNA-seq data. In summary, four genes of the carboxylation module (McBca2, McPpc1, McPpck, and McNAD-Mdh2), three genes of the decarboxylation module (McNADP-ME3, McPpdk1, and McPpdk-RP), and two genes encoding malate transport functions (McALMT4 and MctDT) were selected for initial CAM biodesign functional testing.

Figure 2B:
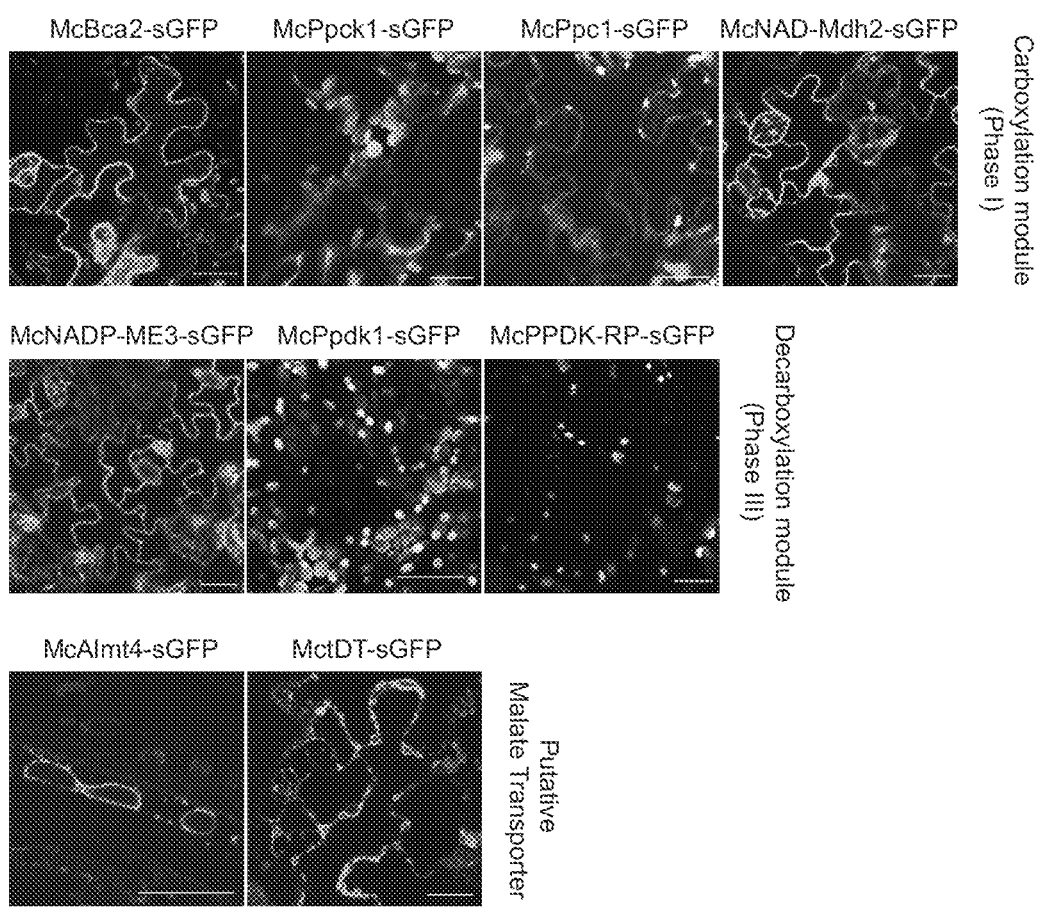
FIG. 2B provides a series of images illustrating subcellular localizations of selected core ice plant CAM gene products in *Arabidopsis*.

FIG. 2B illustrates subcellular localizations of selected core ice plant CAM genes in *Arabidopsis*. To identify subcellular localizations of ice plant CAM genes in *Arabidopsis*, semi-quantitative RT-PCR (reverse transcription polymerase chain reaction) was conducted and each full-length CDS (coding sequences) of candidate CAM genes was cloned into impGWB405 binary vector as protein fusions containing C-terminus sGFP). *Agrobacterium* harboring each vector (35S::McBca2-sGFP, 35S::McPpck-sGFP, 35S::McPpc1-sGFP, 35S::McNAD-Mdh2-sGFP, 35S::McNADP-ME3-sGFP, 35S::McPpdk1-sGFP, 35S::McPPDK-RP-sGFP, 35S::McAlmt4-sGFP, and 35S::MctDT-sGFP) was transformed into *Arabidopsis* and subcellular localization was determined by confocal microscopy. In summary, three fusion proteins (McBCA2-sGFP, McNAD-MDH2-sGFP, and McNADP-ME3-sGFP) were localized to the cytosol, two fusion proteins (McPPCK-sGFP and McPPC1-sGFP) were localized to both the cytosol and the chloroplast, two fusion proteins (McPPDK1-sGFP and McPPDK-RP-sGFP) were localized to the chloroplast, and two fusion proteins (McALMT4-sGFP and MctDT-sGFP) were localized to the tonoplast in *Arabidopsis*.

Figure 3A:
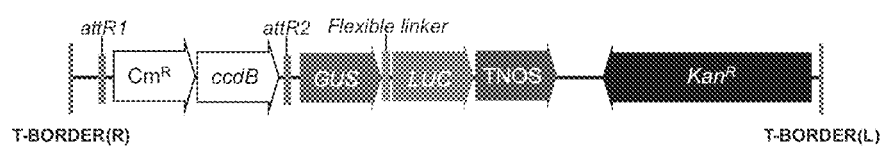
FIG. 3A is a schematic representation of the binary vector construct used for histochemical β-glucuronidase (GUS) staining of selected promoter:GUS reporters selected using in silico promoter prediction approaches.

FIG. 3A is a schematic representation of the binary vector construct used for histochemical β-glucuronidase (GUS) staining of selected promoter:GUS reporters selected using in silico promoter prediction approaches. In order to develop a high throughput system for promoter analysis, a GUS/firefly luciferase (LUC) dual reporter gene was constructed by fusing the full coding sequence of LUC to GUS incorporating a flexible linker between the two reporters to minimize the loss of enzymatic activities and conformational interference in the fusion protein.

Figure 3B:
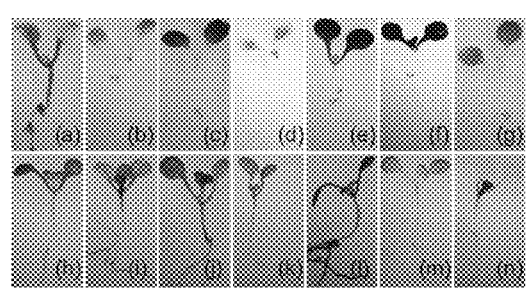
FIGS. 3B and 3C are a series of digital images illustrating tissue-specific expression patterns of 14 selected promoters in *Arabidopsis*.
Figure 3C:
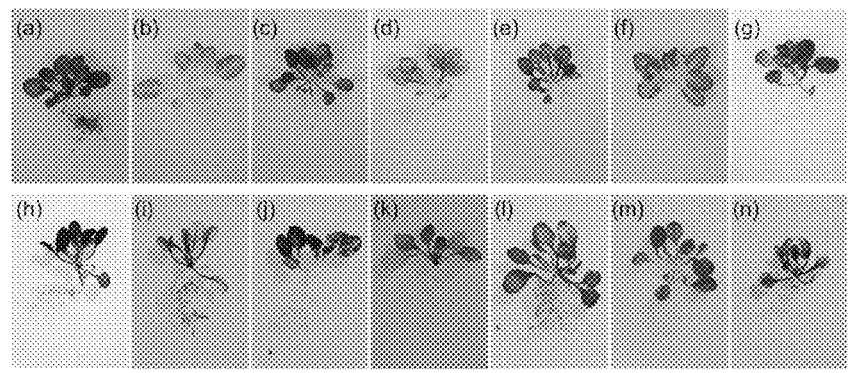

FIG. 3B illustrates histochemical GUS staining of 7-day-old transgenic *Arabidopsis*. FIG. 3C illustrates histochemical GUS staining of 30-day-old transgenic *Arabidopsis*. Public microarray datasets for circadian clock-controlled genes were analyzed using the JTK-Cycle algorithm for robust circadian rhythms (p-value cut-off=0.05). A total of 982 genes were retrieved and their mesophyll expression patterns verified by comparison to the on-line *Arabidopsis* eFP Browser (domain name bar.utoronto.ca/efp/cgi-bin/efpWeb.cgi) as well as mesophyll versus guard cell expression patterns. Of these, 14 out of 982 promoter regions were synthesized and tested for their tissue-specific expression patterns in *Arabidopsis*. *Agrobacterium* GV3101 harboring the constructs of (a) AT3G59350pro1::GUS/LUC, (b) AT4G32340pro2::GUS/LUC, (c) AT5G23240pro3::GUS/LUC, (d) AT5G44050pro4::GUS/LUC, (e) AT4G04330pro5::GUS/LUC, (f) AT4G23290pro6::GUS/LUC, (g) AT1G07180pro7::GUS/LUC, (h) AT1G65490pro8::GUS/LUC, (i) AT1G21670pro9::GUS/LUC, (j) AT2G17450pro10::GUS/LUC, (k) AT4G01130pro11::GUS/LUC, (l) AT5G19240pro12::GUS/LUC, (m) AT5G58120pro13::GUS/LUC, and (n) AT3G47340pro14::GUS/LUC were transformed into wild-type *Arabidopsis* (Col-0) and tissue-specific expression patterns of each of $T_1$ transgenic lines were evaluated by GUS staining. In summary, all of the selected 14 *Arabidopsis* promoters directed very strong GUS activity within the leaves of *Arabidopsis*.

Figure 4:
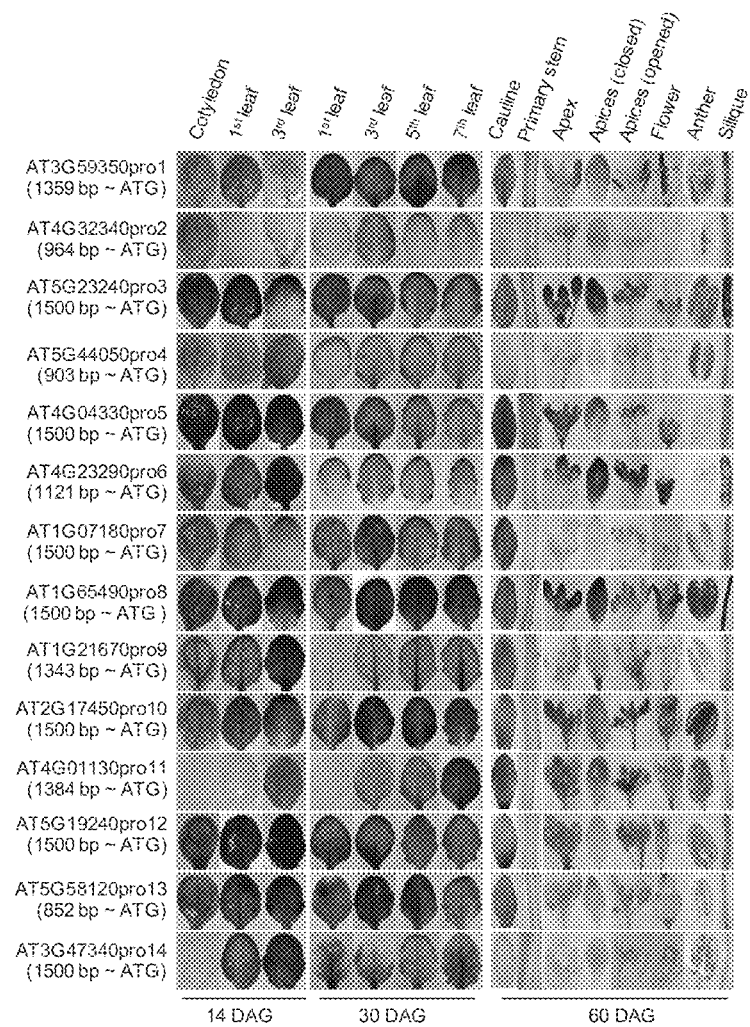
FIG. 4 provides digital images of representative GUS-stained tissues of 14 selected *Arabidopsis* promoters driving GUS expression at various stages of *Arabidopsis* growth and development.

FIG. 4 provides representative GUS-stained tissues of 14 selected *Arabidopsis* promoters driving GUS expression at various stages of *Arabidopsis* growth and development. Transgenic *Arabidopsis* plants were grown on ½ MS medium containing kanamycin (50 mg ml-l) for 30 days. GUS-stained images of detached leaves were captured at 14 and 30 days after germination (DAG). Each line of transgenic *Arabidopsis* was grown on soil for 60 days and detached-cauline leaves, primary inflorescence stems, flowers, anthers, and siliques were stained for GUS activity. In summary, the 14 selected *Arabidopsis* promoters drove very strong GUS activity in rosette and cauline leaves at various stages of *Arabidopsis* growth and development.

Figure 5:
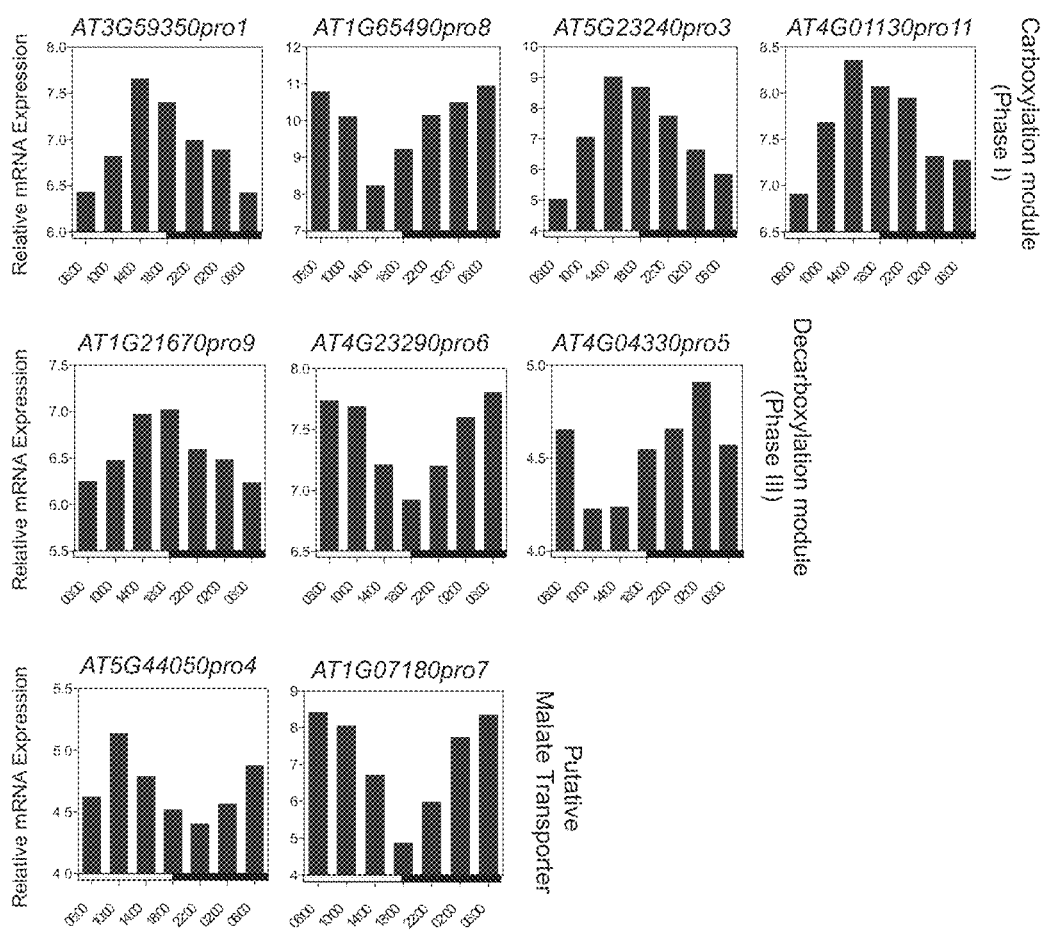
FIG. 5 provides a series of graphs illustrating rhythmic, circadian expression patterns of nine candidate promoters for expressing of ice plant core CAM genes in *Arabidopsis*.

Rhythmic, circadian expression patterns of nine candidate promoters for expressing of ice plant core CAM genes in *Arabidopsis* are provided in FIG. 5. Based upon these promoter expression patterns, nine out of 14 selected promoters were selected to drive the expression of nine core CAM genes in *Arabidopsis*. The coding sequences of McBca2, McPpck, McPpc1, McNAD-Mdh2, McNADP-ME3, McPpdk1, McPpdk-RP, McALMT4, and MctDT were driven by AT3G59350pro1, AT1G65490pro8, AT5G23240pro3, AT4G01130pro11, AT1G21670pro9, AT4G23290pro6, AT4G04330pro5, AT5G44050pro4, and AT1G07180pro7, respectively. Native terminator regions of the indicated *Arabidopsis* genes were also used in the construction of these CAM gene cassettes.

FIGS. 6A-6D provide schematic illustrations of vector constructs used for multiple CAM gene expression in planta. Current genetic engineering approaches are often not well suited for manipulating or stacking large numbers of plant transgenes. Furthermore, assembly of multi-transcription units (TU) without insulating elements can suffer from transcriptional interference and gene expression can be significantly reduced by heterochromatin-mediated gene silencing. To address these issues, a new framework for quick and reliable assembly was developed for complex gene circuits for engineering plant genes using Multisite Gateway cloning and Gibson isothermal assembly methods.

Figure 6A:
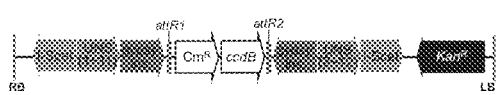
FIGS. 6A-6D provide schematic illustrations of vector constructs used for the expression of multiple CAM genes in planta.

FIG. 6A is a schematic illustration of the position binary vector. For every position binary vector, two fragments of gypsy barrier insulator with different directions (forward and reverse complementary) were employed to prevent the heterochromatin-mediated gene silencing in *Arabidopsis*. A combination of 2 different unique sequences (UNSes) and I-sce I homing enzyme were cloned into the 11 position binary vectors for Gibson isothermal assembly. The UNSes in the position binary vectors determine the position of each TU within the large gene circuit and attachment (att) R1 and R2 sites are used for Multisite gateway cloning to construct each CAM gene cassette (promoter, gene, protein tag, and terminator).

Figure 6B:
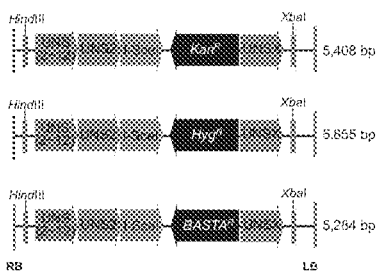
Figure 6C:
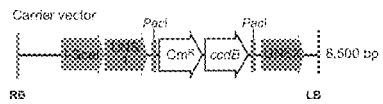
Figure 6D:
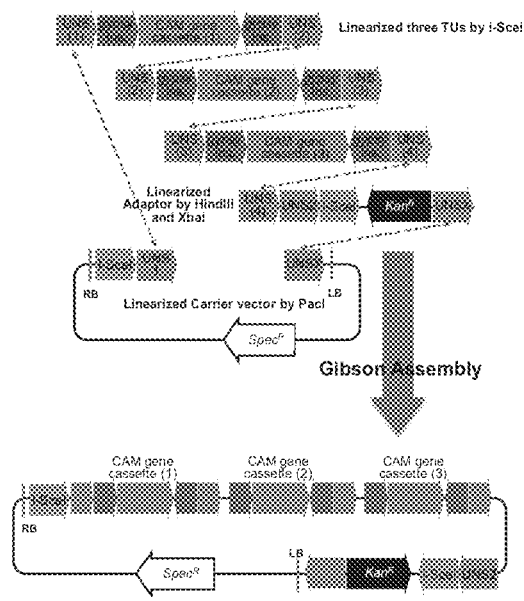

FIG. 6B is a schematic illustration of adaptor vectors. Three different gene cassettes of plant selectable markers (e.g., kanamycin, hygromycin, and BASTA) were cloned into the adaptor vectors with different UNSes for selecting of transgenic plants. FIG. 6C is a schematic illustration of the carrier vector. I-sce I and UNSes in carrier vector can allow for further rounds of assemblies and T-DNA right and left borders were used for *Agrobacterium*-mediated plant transformation. FIG. 6D provides schematics of CAM gene assembly process. In summary, a total of 11 position binary vectors, 33 adaptor vectors, and a carrier vector were constructed to generate large CAM gene circuit for the quick and reliable multi-gene assembly system. The entire sequence of Position Binary Vectors (PBV; SEQ ID NOS: 15-25), Adaptor Vectors for kanamycin (AVK; SEQ ID NOS: 26-36), hygromycin (AVH; SEQ ID NOS: 37-47), and BASTA resistance (AVB; SEQ ID NOS: 48-58), and the carrier vector (SEQ ID NO: 59) are provided in the Sequence listed provided herewith.

Figure 7:
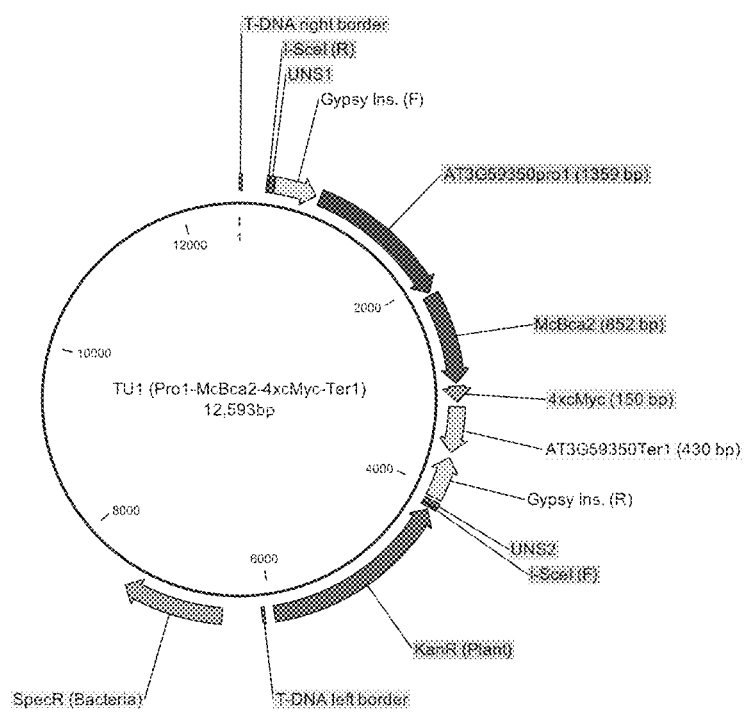
FIG. 7 provides a schematic representation of McBca2 (Beta carbonic anhydrase 2) gene cassette in position binary vector 1.

FIG. 7 provides a schematic representation of McBca2 (Beta carbonic anhydrase 2) gene cassette in position binary vector 1. Each part vector harboring AT3G59350pro1 (5'-upstream region; −1114 to +245), McBca2 gene, 4×cMyc protein tag, and AT3G59350Ter1 (3'-downstream region; +2199 to +2629) were recombined with position binary vector 1 via the Mutisite Gateway™ cloning system. The entire sequence of position binary vector 1 containing the McBca2 gene cassette has the nucleic acid sequence of SEQ ID NO: 60.

Figure 8:
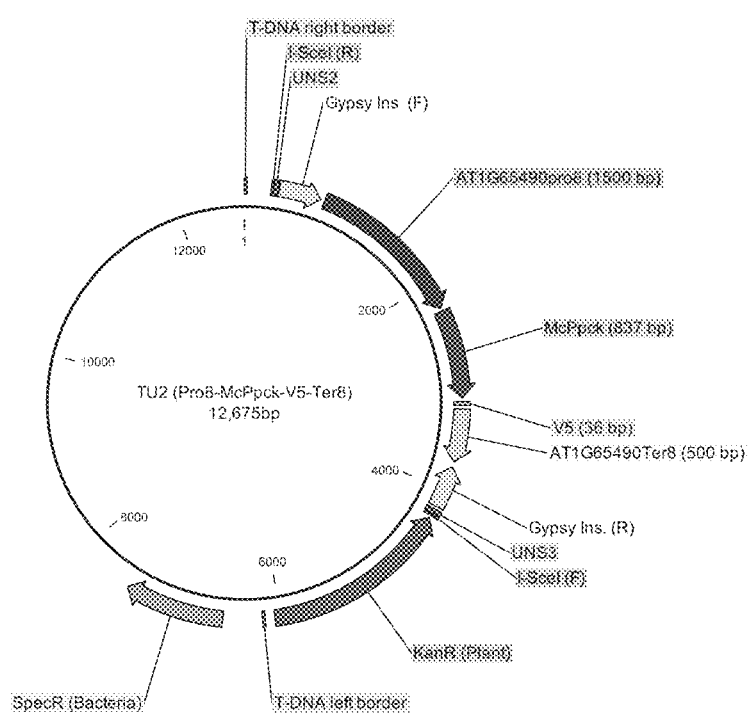
FIG. 8 is a schematic representation of McPpck (phosphoenolpyruvate carboxylase kinase) gene cassette in position binary vector 2.

FIG. 8 is a schematic representation of McPpck (phosphoenolpyruvate carboxylase kinase) gene cassette in position binary vector 2. Each part vector harboring AT1G65490pro8 (5'-upstream region; −1479 to +21), McPpck gene, V5 protein tag, and AT1G65490Ter8 (3'-downstream region; +406 to +905) were recombined with position binary vector 2 via Mutisite Gateway™ cloning system. The entire sequence of position binary vector 2 containing the McPpck gene cassette is presented as SEQ ID NO: 61.

Figure 9:
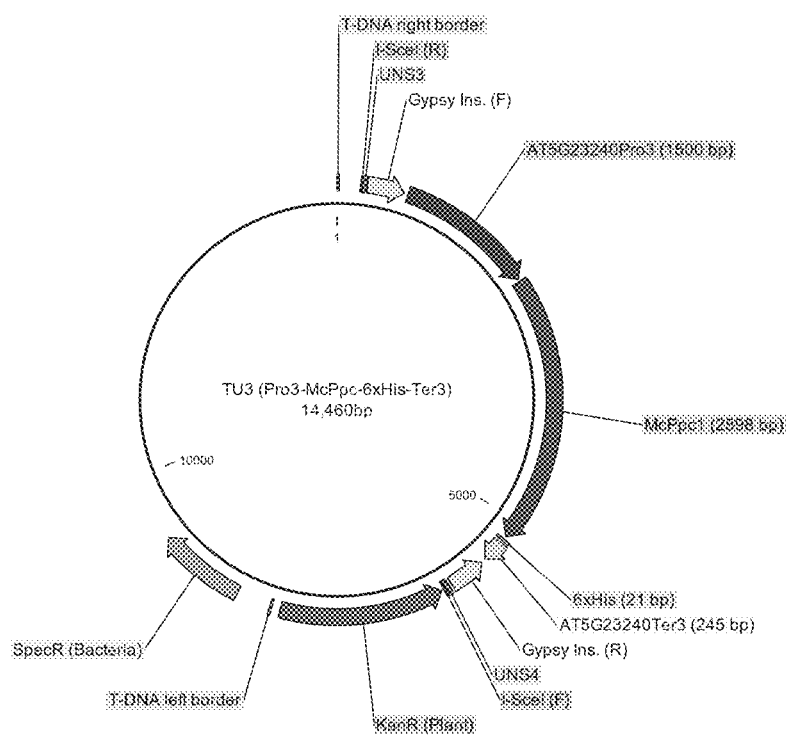
FIG. 9 is a schematic representation of McPpc1 (phosphoenolpyruvate carboxylase) gene cassette in position binary vector 3.

FIG. 9 is a schematic representation of McPpc1 (phosphoenolpyruvate carboxylase) gene cassette in position binary vector 3. Each part vector harboring AT5G23240pro3 (5'-upstream region; −1310 to +190), McPpc1 gene, 6×His protein tag, and AT5G23240Ter3 (3'-downstream region; +1869 to +2113) were recombined with position binary vector 3 via Mutisite Gateway™ cloning system. The entire sequence of position binary vector 3 containing the McPpc1 gene cassette is presented as SEQ ID NO: 62.

Figure 10:
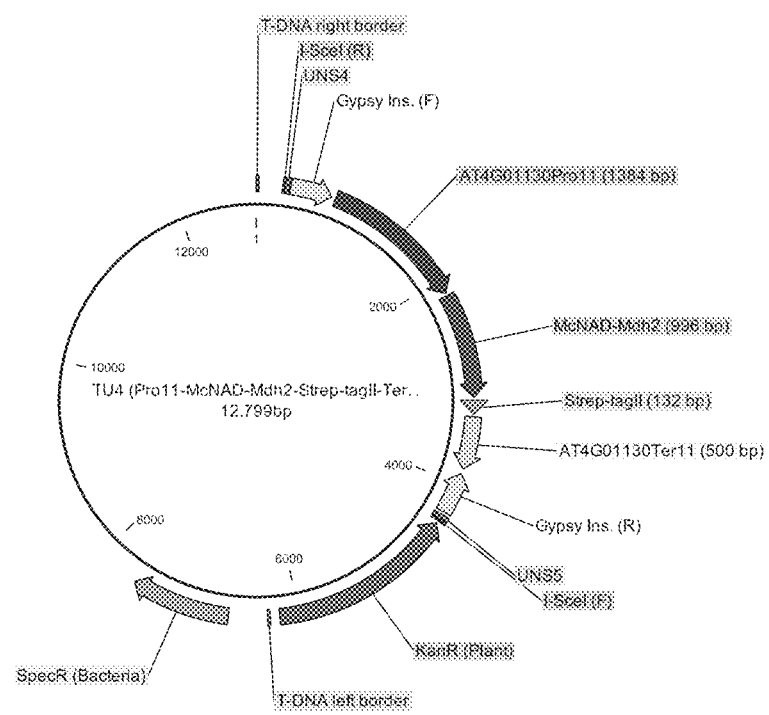
FIG. 10 is a schematic representation of McMDH2 [NAD (P) malate dehydrogenase 2] gene cassette in position binary vector 4.

FIG. 10 is a schematic representation of McNAD-Mdh2 [NAD(P) malate dehydrogenase 2] gene cassette in position binary vector 4. Each part vector harboring AT4G01130pro11 (5'-upstream region; −1349 to +35), McNAD-McMdh2 gene, Step-tag II protein tag, and AT4G01130Ter11 (3'-downstream region; +2176 to +2675) were recombined with position binary vector 4 via Mutisite Gateway™ cloning system. The entire sequence of position binary vector 4 containing the McMdh2 gene cassette is presented as SEQ ID NO: 63.

Figure 11:
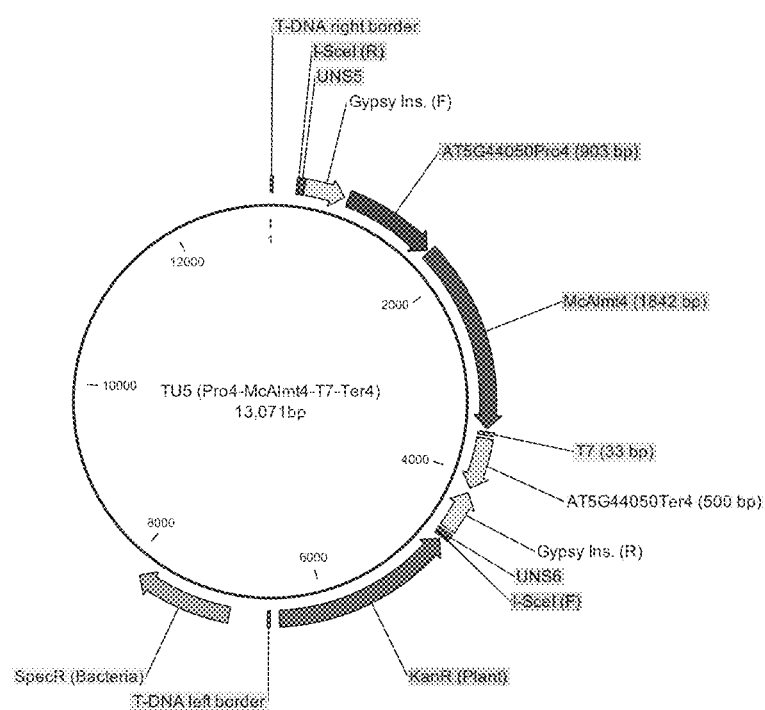
FIG. 11 is a schematic representation of McALMT4 (putative aluminum-activated malate transporter) gene cassette in position binary vector 5.

FIG. 11 is a schematic representation of McALMT4 (putative aluminum-activated malate transporter) gene cassette in position binary vector 5. Each part vector harboring AT5G44050pro4 (5'-upstream region; −903 to −1), McALMT4 gene, T7 protein tag, and AT5G44050Ter4 (3'-downstream region; +3727 to +4226) were recombined with position binary vector 5 via Multisite Gateway™ cloning system. The entire sequence of position binary vector 5 containing the McAlmt4 gene cassette is presented as SEQ ID NO: 64.

Figure 12:
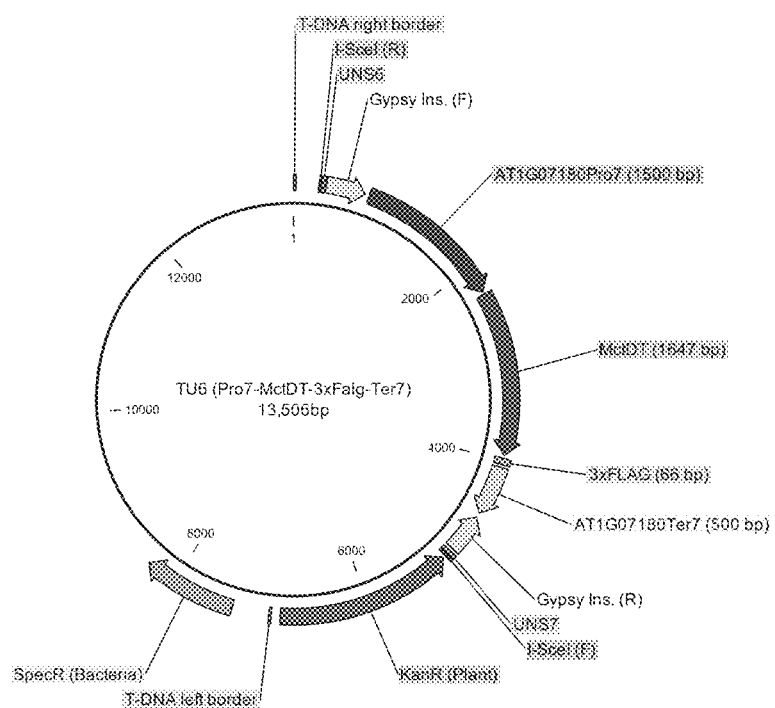
FIG. 12 is a schematic representation of MctDT (tonoplast dicarboxylate transporter) gene cassette in position binary vector 6.

FIG. 12 is a schematic representation of MctDT (tonoplast dicarboxylate transporter) gene cassette in position binary vector 6. Each part vector harboring AT1G07180pro7 (5'-upstream region; −1406 to +94), MctDT gene, 3×FLAG protein tag, and AT1G07180Ter7 (3'-downstream region; +2455 to +2954) were recombined with position binary vector 6 via Mutisite Gateway™ cloning system. The entire sequence of position binary vector 6 containing the MctDT gene cassette is presented as SEQ ID NO: 65.

Figure 13:
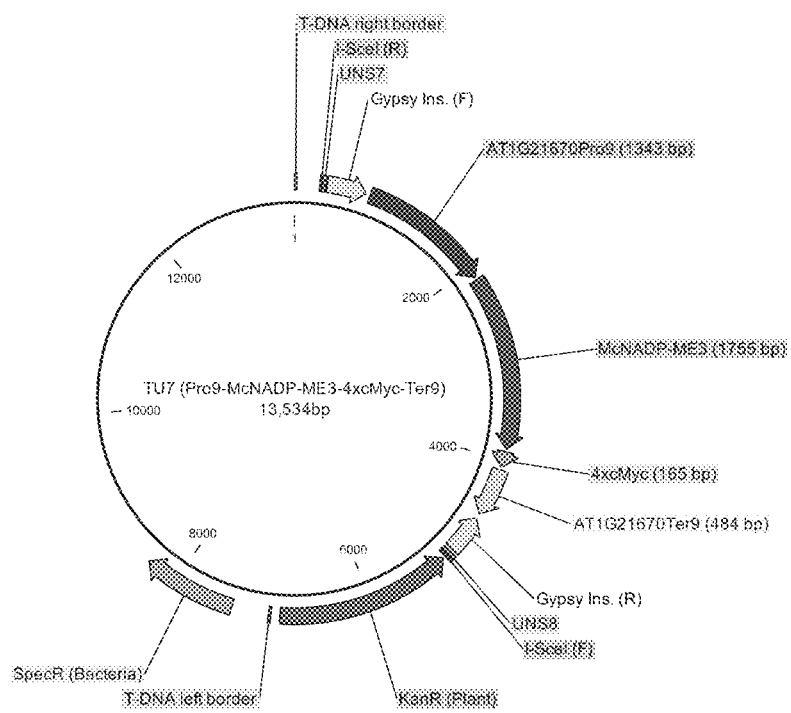
FIG. 13 is a schematic representation of McNADP-ME3 (NADP-dependent malic enzyme 3) gene cassette in position binary vector 7.

FIG. 13 is a schematic representation of McNADP-ME3 (NADP-dependent malic enzyme 3) gene cassette in position binary vector 7. Each part vector harboring AT1G21670pro9 (5'-upstream region; −1332 to +11), McNADP-ME3 gene, 4×cMyc protein tag, and AT1G21670Ter9 (3'-downstream region; +2124 to +2607) were recombined with position binary vector 7 via Mutisite Gateway™ cloning system. The entire sequence of position binary vector 7 containing the McNADP-ME3 gene cassette is presented as SEQ ID NO: 66.

Figure 14:
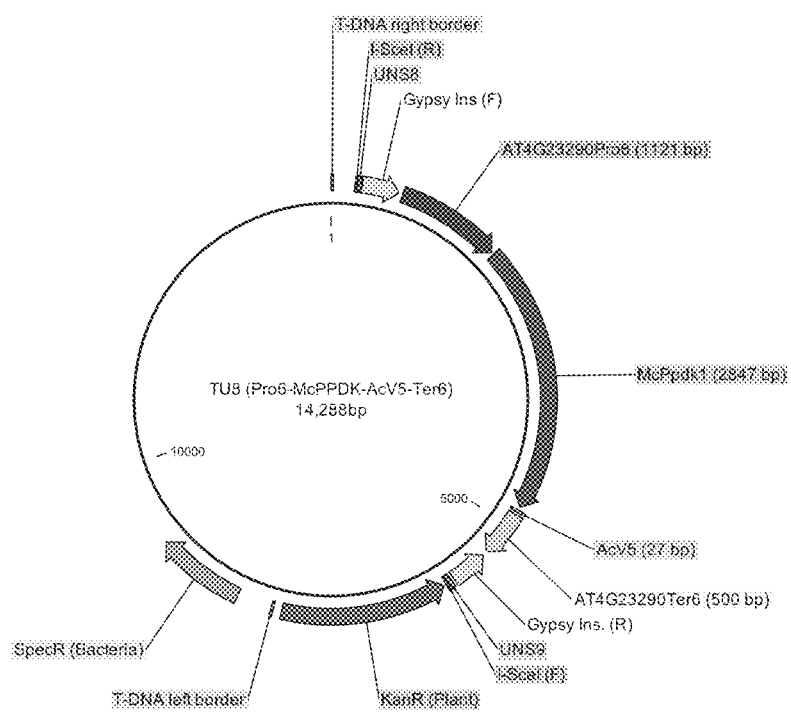
FIG. 14 is a schematic representation of McPpdk1 (pyruvate orthophosphate dikinase) gene cassette in position binary vector 8.

FIG. 14 is a schematic representation of McPpdk1 (pyruvate orthophosphate dikinase) gene cassette in position binary vector 8. Each part vector harboring AT4G23290pro6 (5'-upstream region; −1105 to +16), McPpdk1 gene, AcV5 protein tag, and AT4G23290Ter6 (3'-downstream region; +2918 to +3417) were recombined with position binary vector 8 via Mutisite Gateway™ cloning system. The entire sequence of position binary vector 8 containing the McPpdk1 gene cassette is presented as SEQ ID NO: 67.

Figure 15:
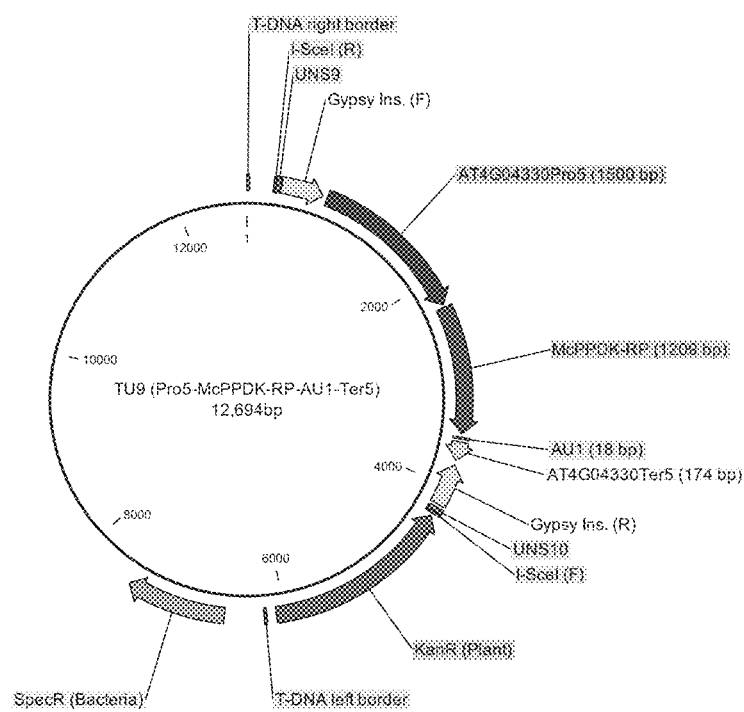
FIG. 15 is a schematic representation of McPpdk-RP (pyruvate orthophosphate dikinase-regulatory protein) gene cassette in position binary vector 9.

FIG. 15 is a schematic representation of McPpdk-RP (pyruvate orthophosphate dikinase-regulatory protein) gene cassette in position binary vector 9. Each part vector harboring AT4G04330pro5 (5'-upstream region; −1466 to +34), McPpdk-RP gene, AU1 protein tag, and AT4G04330Ter5 (3'-downstream region; +1899 to +2072) were recombined with position binary vector 9 via Mutisite Gateway™ cloning system. The entire sequence of position binary vector 9 containing the McPpdk-RP gene cassette is presented as SEQ ID NO: 68.

Figure 16A:
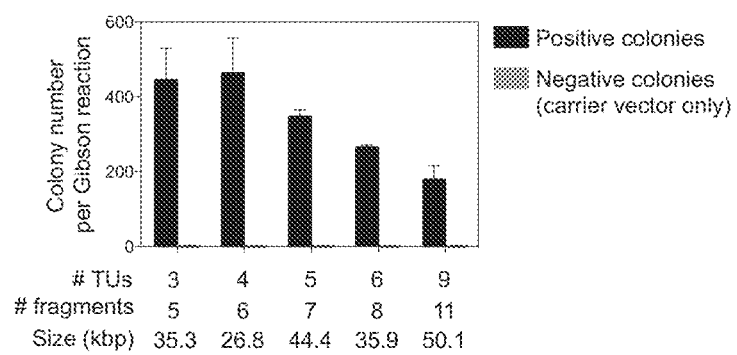
FIGS. 16A and 16B illustrate the cloning efficiency of CAM gene cassette via Gibson isothermal assembly.
Figure 16B:
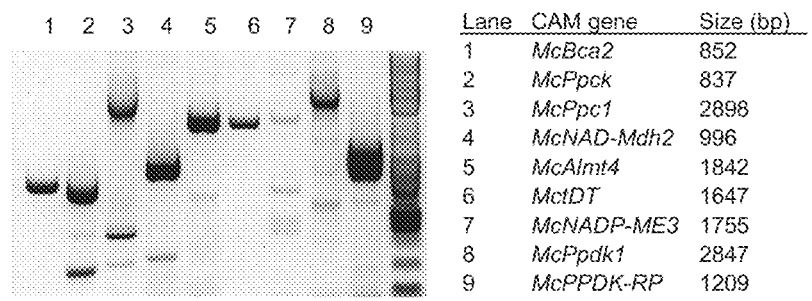

FIGS. 16A and 16B illustrate the cloning efficiency of CAM gene cassette via Gibson isothermal assembly. FIG. 16A is a graph showing each combination of the CAM gene transcription units and plant selectable marker (hygromycin resistance gene cassette) were assembled into a linear carrier vector using Gibson isothermal assembly method. The number of colonies indicates efficiency of the assembly system. Size in Kilobases is the predicted size of the gene circuits. FIG. 16B is a digital image taken following PCR-amplification of CAM genes from the large CAM gene circuit containing 9 gene cassettes. The full-length coding sequences of 9 CAM genes were amplified with appropriate primer pairs. The PCR products were separated on 1% agarose gel. In summary, developed vector sets were efficiently assembled as a large number of CAM gene cassettes (9 CAM gene cassettes) via the Gibson isothermal assembly method.

Figure 17:
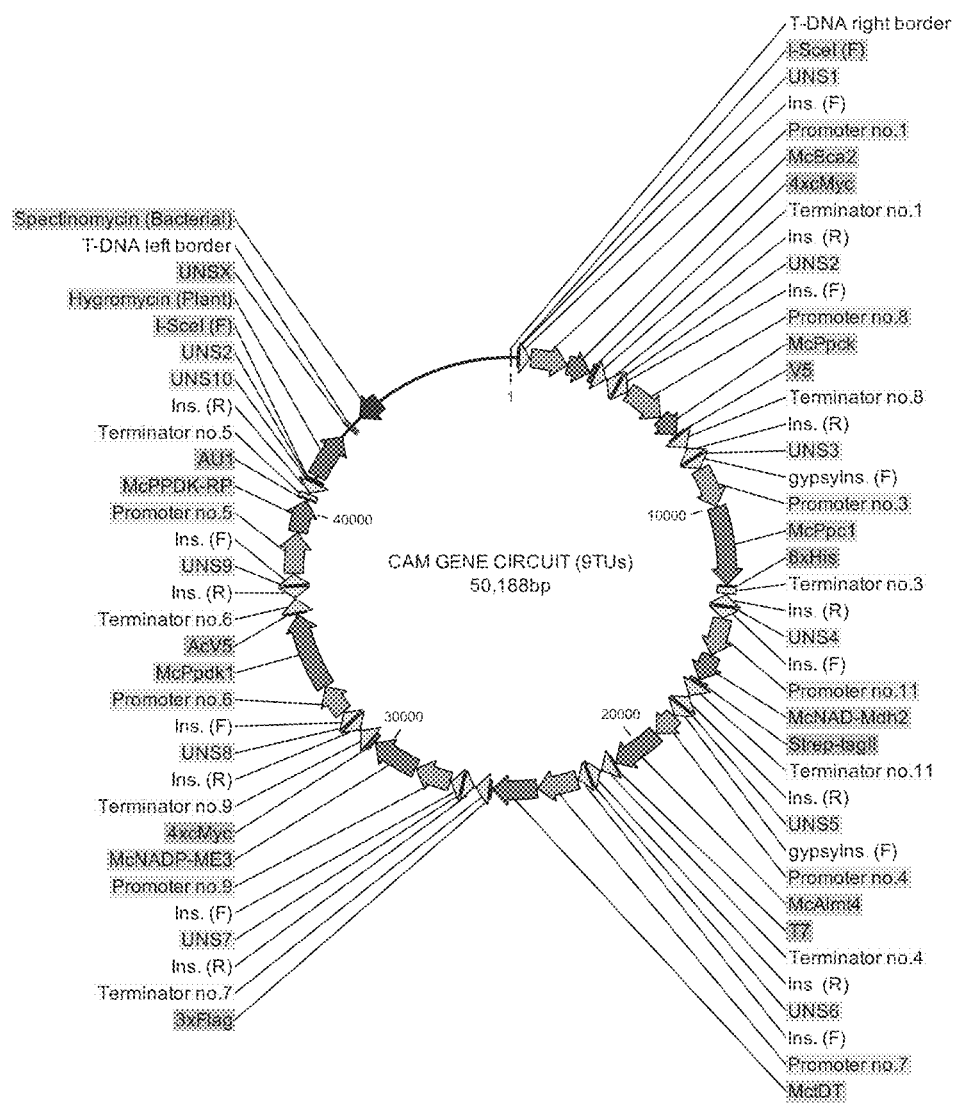
FIG. 17 is a schematic representation of a CAM gene circuit for introducing CAM photosynthetic machinery into the $C_3$ photosynthesis plant *Arabidopsis*.

FIG. 17 is a schematic representation of a CAM gene circuit for introducing CAM photosynthetic machinery into $C_3$ Arabidopsis. The unique sequences (UNSes) in the position binary vector determine the CAM gene cassette's position within the CAM gene circuit. To assemble this CAM gene expression cassette, each of the 9 position binary vectors was digested by I-sce I homing enzyme. Each of the nine purified CAM gene cassettes were combined with equimolar amounts of predigested adaptor and carrier vector by the Gibson isothermal assembly method. The Gibson reaction mix exposes the UNSes, permitting annealing, extension, and ligation to form a single large CAM gene circuit. In summary, the entire CAM gene circuit will be transformed into wild-type Arabidopsis and the tissue-succulence engineered Arabidopsis and evaluated for the performance of CAM. Entire sequence of CAM gene circuit containing 9 CAM gene cassettes (TU's Transcription Units) is presented as SEQ ID NO: 69.

Figure 18:
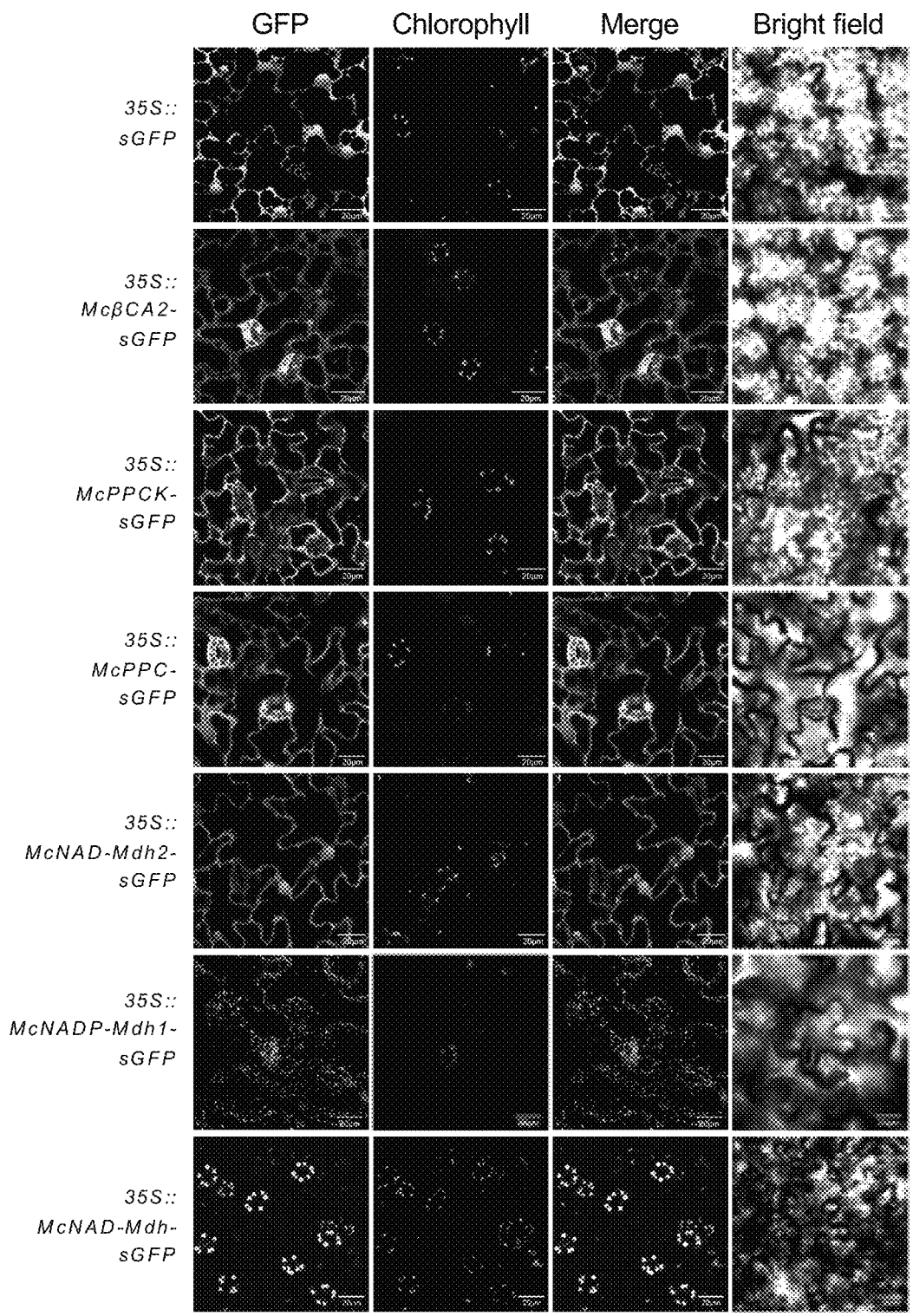
FIG. 18 illustrates subcellular localizations of selected core ice plant CAM genes of the carboxylation module expressed in *Arabidopsis*.

FIG. 18 illustrates subcellular localizations of selected core ice plant CAM genes of the carboxylation module expressed in Arabidopsis. To identify subcellular localizations of ice plant CAM genes in Arabidopsis, semiquantitative RT-PCR (reverse transcription polymerase chain reaction) was conducted and each full-length CDS (coding sequences) of candidate CAM genes was cloned into pGWB405 binary vector as protein fusions containing C-terminal sGFP. Agrobacterium harboring 35S::sGFP (EV control), 35S::McβCA2-sGFP, 35S::McPPCK1-sGFP, 35S::McPPC1-sGFP, 35S::McNAD-Mdh2-sGFP, 35S::McNADP-Mdh1-sGFP, or 35S::McNAD-Mdh-sGFP was transformed into Arabidopsis and subcellular localization was determined by confocal microscopy.

Figure 19:
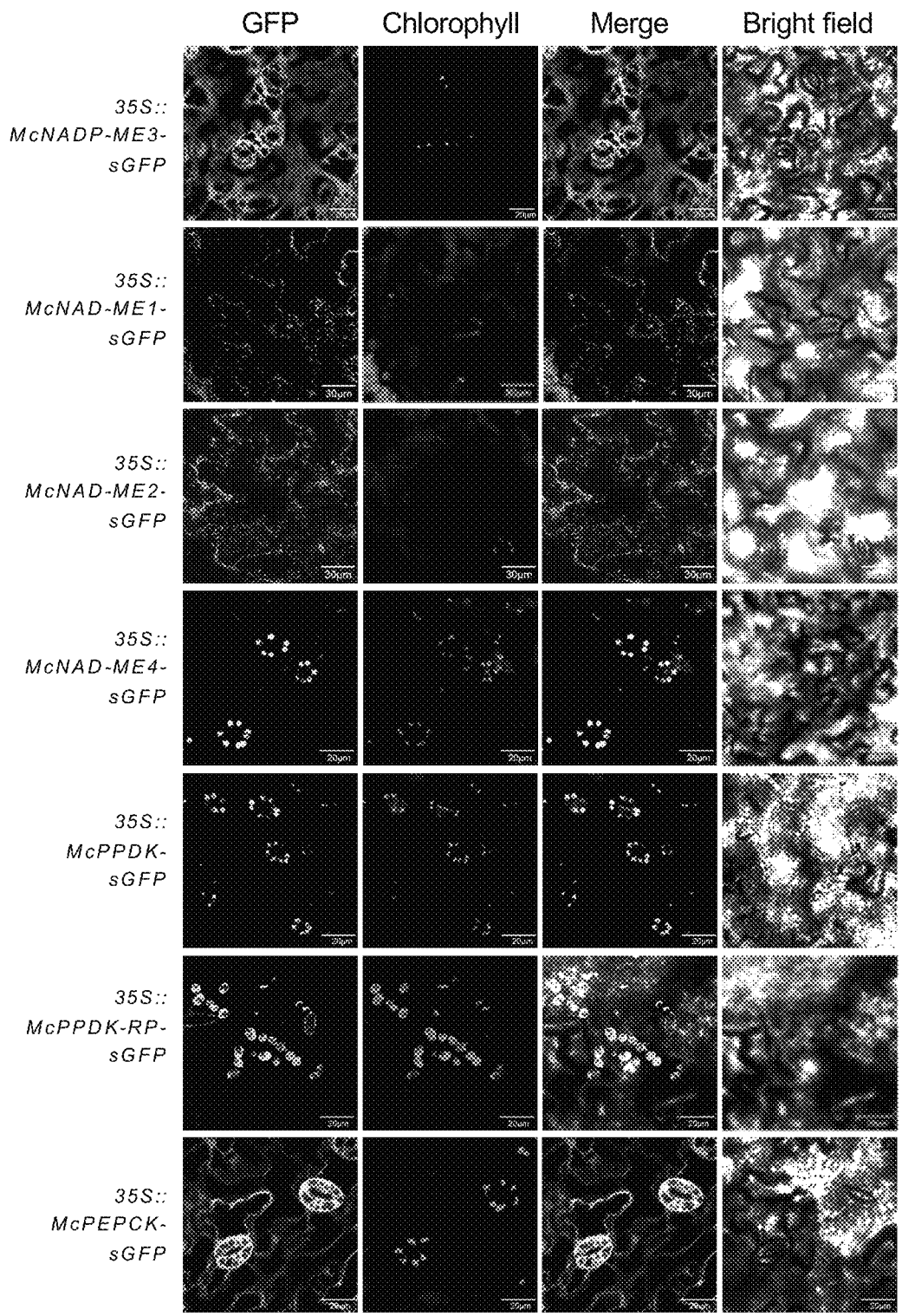
FIG. 19 illustrates subcellular localizations of selected core ice plant CAM genes of the decarboxylation module in *Arabidopsis*.

FIG. 19 illustrates subcellular localizations of selected core ice plant CAM genes of the decarboxylation module in Arabidopsis. Agrobacterium harboring 35S::McNADP-ME3-sGFP, 35S::McNAD-ME1-sGFP, 35S::McNAD-ME2-sGFP, 35S::McNAD-ME4-sGFP, 35S::McPPDK-sGFP, 35S::McPPDK-RP-sGFP, or 35S::McPEPCK-sGFP was transformed into Arabidopsis and subcellular localization was determined by confocal microscopy.

Figure 20:
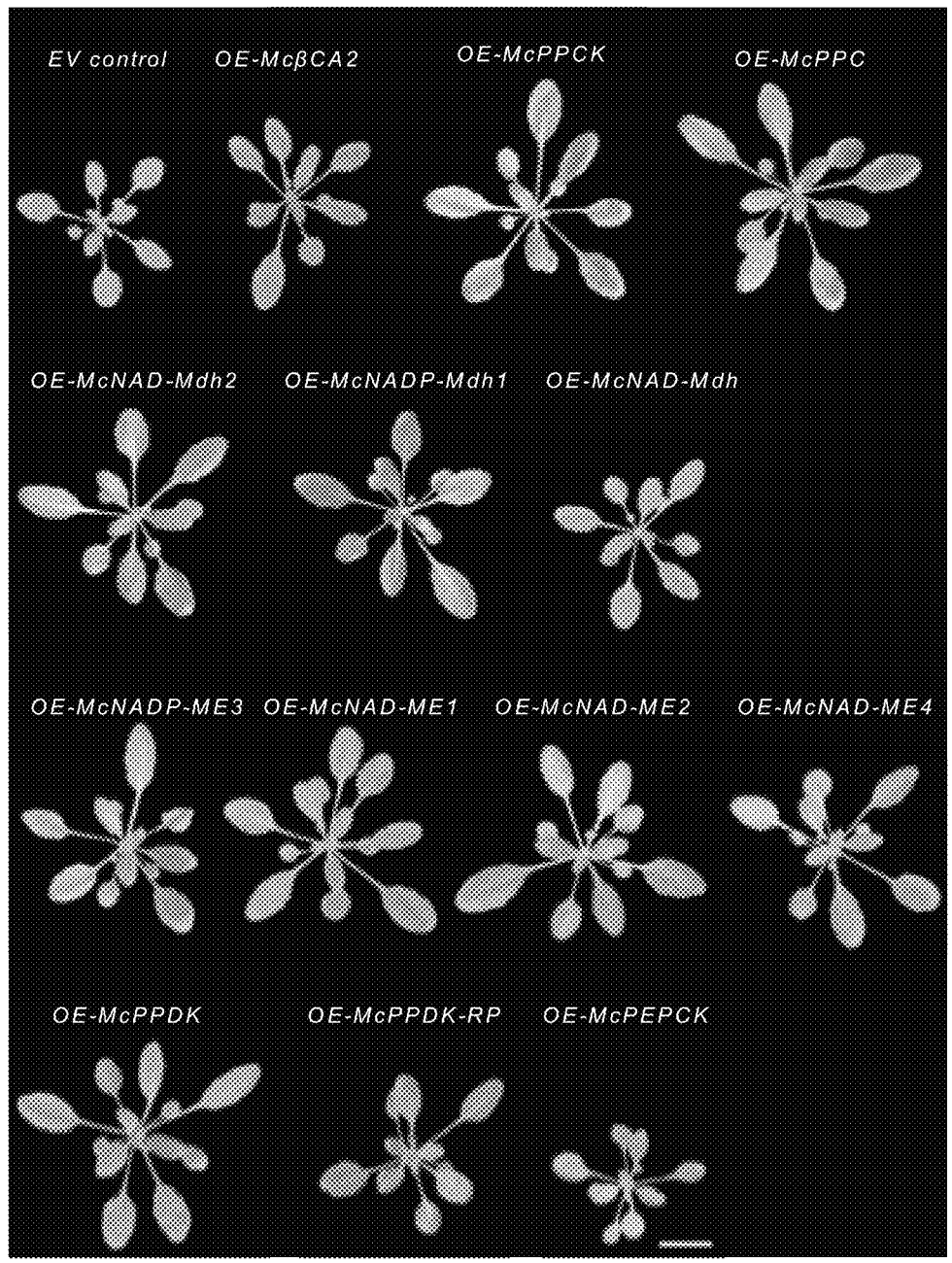
FIG. 20 illustrates overexpression of each core ice plant CAM gene alters overall plant size in *Arabidopsis*.

FIG. 20 illustrates overexpression of each core ice plant CAM gene alters overall plant size in Arabidopsis. Representative images of 4-week-old 35S::sGFP Empty Vector (EV) control, 35S::McβCA2-sGFP, 35S::McPPCK1-sGFP, 35S::McPPC1-sGFP, 35S::McNAD-Mdh2-sGFP, 35S::McNADP-Mdh1-sGFP, or 35S::McNAD-Mdh-sGFP, 35S::McNADP-ME3-sGFP, 35S::McNAD-ME1-sGFP, 35S::McNAD-ME2-sGFP, 35S::McNAD-ME4-sGFP, 35S::McPPDK-sGFP, 35S::McPPDK-RP-sGFP, and 35S::McPEPCK-sGFP transgenic plant. Bar=2 cm.

Figure 21:
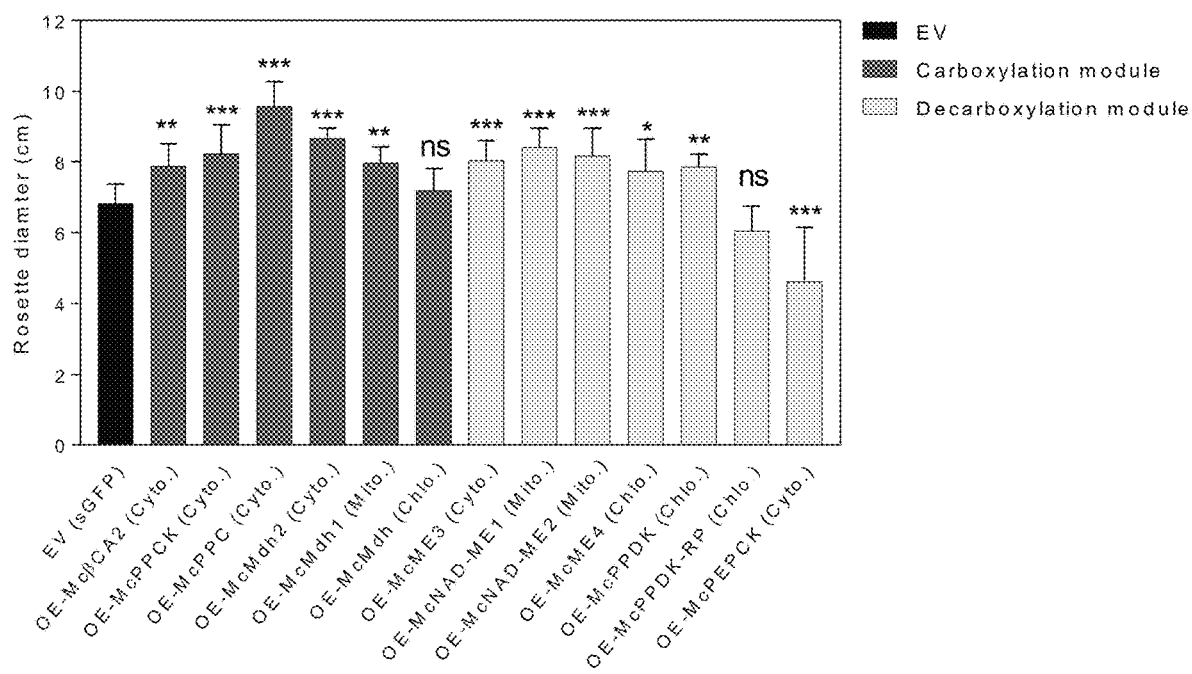
FIG. 21 illustrates overexpression of core ice plant CAM gene increases rosette size in *Arabidopsis*.

FIG. 21 illustrates overexpression of core ice plant CAM gene increases rosette size in Arabidopsis. T3 homozygous seeds of 35S::sGFP Empty Vector (EV) control, 35S::McβCA2-sGFP, 35S::McPPCK1-sGFP, 35S::McPPC1-sGFP, 35S::McNAD-Mdh2-sGFP, 35S::McNADP-Mdh1-sGFP, or 35S::McNAD-Mdh-sGFP, 35S::McNADP-ME3-sGFP, 35S::McNAD-ME1-sGFP, 35S::McNAD-ME2-sGFP, 35S::McNAD-ME4-sGFP, 35S::McPPDK-sGFP, 35S::McPPDK-RP-sGFP, and 35S::McPEPCK-sGFP were germinated and grown in soil mix under a 12-h photoperiod. 4-week-old rosette images were captured and rosette diameter was measured by image J software. Values represent means±s.d., ns=non-significant, *p<0.05, p<0.01, and *p<0.001, One-way ANOVA with Dunnett's multiple comparison test. n=10.

Figure 22:
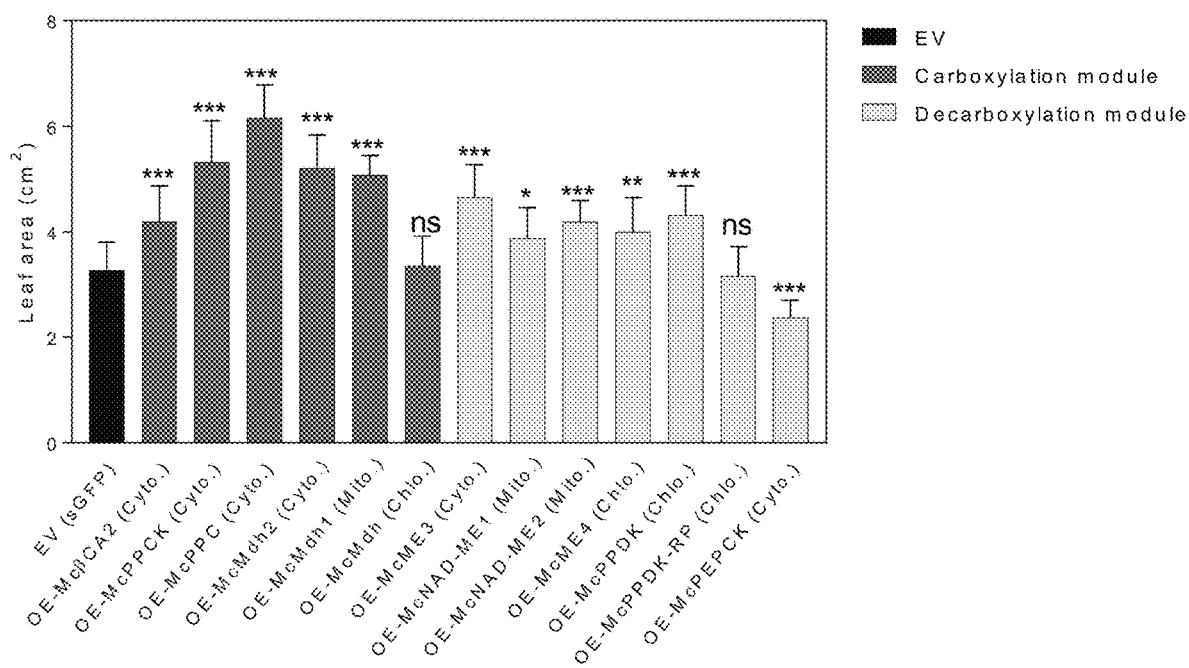
FIG. 22 illustrates overexpression of core ice plant CAM gene increases leaf size in *Arabidopsis*.

FIG. 22 illustrates overexpression of core ice plant CAM gene increases leaf size in *Arabidopsis*. T3 homozygous seeds of 35S::sGFP Empty Vector (EV) control, 35S::McβCA2-sGFP, 35S::McPPCK1-sGFP, 35S::McPPC1-sGFP, 35S::McNAD-Mdh2-sGFP, 35S::McNADP-Mdh1-sGFP, or 35S::McNAD-Mdh-sGFP, 35S::McNADP-ME3-sGFP, 35S::McNAD-ME1-sGFP, 35S::McNAD-ME2-sGFP, 35S::McNAD-ME4-sGFP, 35S::McPPDK-sGFP, 35S::McPPDK-RP-sGFP, and 35S::McPEPCK-sGFP were germinated and grown in soil mix under a 12-h photoperiod. 4-week-old leaf images were captured and leaf area was measured by image J software. Values represent means±s.d., ns=non-significant, *p<0.05, p<0.01, and *p<0.001, One-way ANOVA with Dunnett's multiple comparison test. n=22.

Figure 23:
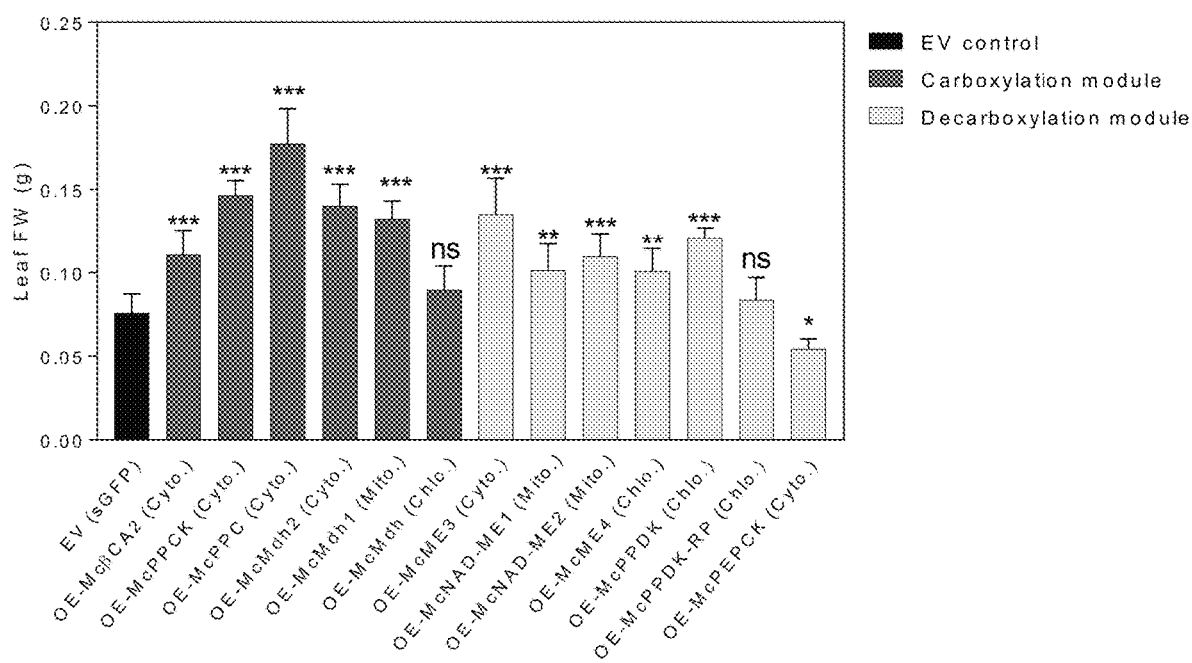
FIG. 23 illustrates overexpression of core ice plant CAM gene increases leaf FW in *Arabidopsis*.

FIG. 23 illustrates overexpression of core ice plant CAM gene increases leaf FW in *Arabidopsis*. T3 homozygous seeds of 35S::sGFP Empty Vector (EV) control, 35S::McβCA2-sGFP, 35S::McPPCK1-sGFP, 35S::McPPC1-sGFP, 35S::McNAD-Mdh2-sGFP, 35S::McNADP-Mdh1-sGFP, or 35S::McNAD-Mdh-sGFP, 35S::McNADP-ME3-sGFP, 35S::McNAD-ME1-sGFP, 35S::McNAD-ME2-sGFP, 35S::McNAD-ME4-sGFP, 35S::McPPDK-sGFP, 35S::McPPDK-RP-sGFP, and 35S::McPEPCK-sGFP were germinated and grown in soil mix under a 12-h photoperiod. 4-week-old leaf was sampled and measured fresh weight (FW). Values represent means±s.d., ns=non-significant, *p<0.05, p<0.01, and *p<0.001, One-way ANOVA with Dunnett's multiple comparison test. n=10.

Figure 24:
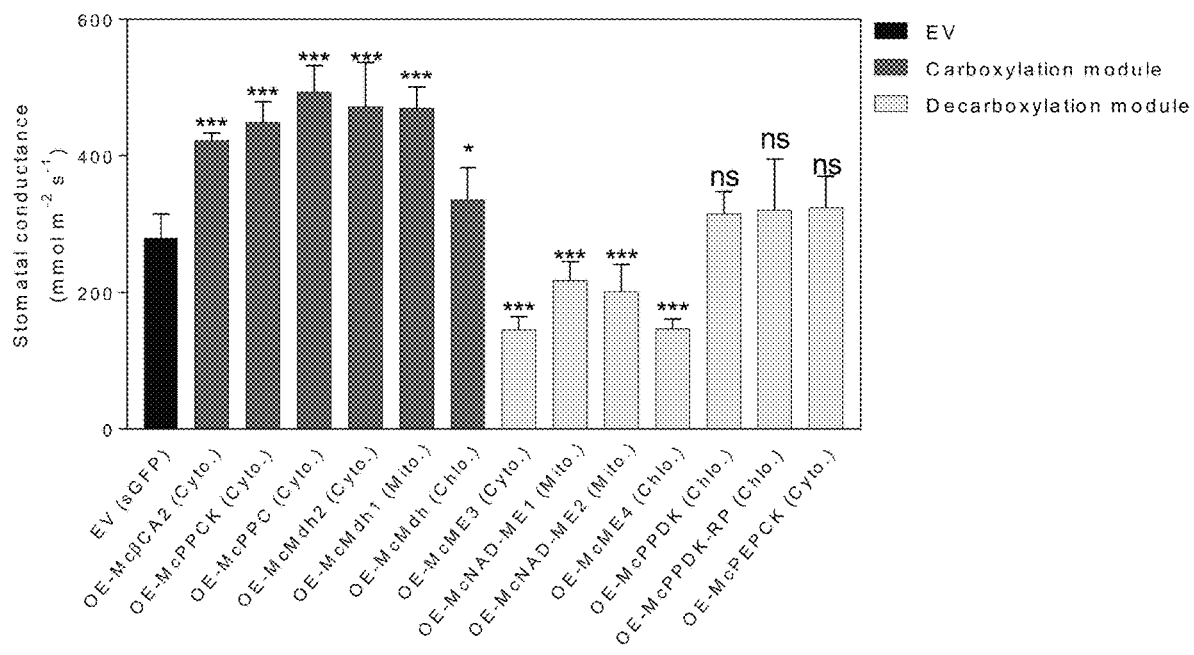
FIG. 24 illustrates Overexpression of core ice plant CAM gene alters leaf stomatal conductance in *Arabidopsis*.

FIG. 24 illustrates Overexpression of core ice plant CAM gene alters leaf stomatal conductance in *Arabidopsis*. T3 homozygous seeds of 35S::sGFP Empty Vector (EV) control, 35S::McβCA2-sGFP, 35S::McPPCK1-sGFP, 35S::McPPC1-sGFP, 35S::McNAD-Mdh2-sGFP, 35S::McNADP-Mdh1-sGFP, or 35S::McNAD-Mdh-sGFP, 35S::McNADP-ME3-sGFP, 35S::McNAD-ME1-sGFP, 35S::McNAD-ME2-sGFP, 35S::McNAD-ME4-sGFP, 35S::McPPDK-sGFP, 35S::McPPDK-RP-sGFP, and 35S::McPEPCK-sGFP were germinated and grown in soil mix under a 12-h photoperiod. 4-week-old leaf was used to measure stomatal conductance by SC-1 Leaf Porometer (Decagon Devices, Inc.). Values represent means±s.d., ns=non-significant, *p<0.05 and ***p<0.001, One-way ANOVA with Dunnett's multiple comparison test. n=10.

Figure 25:
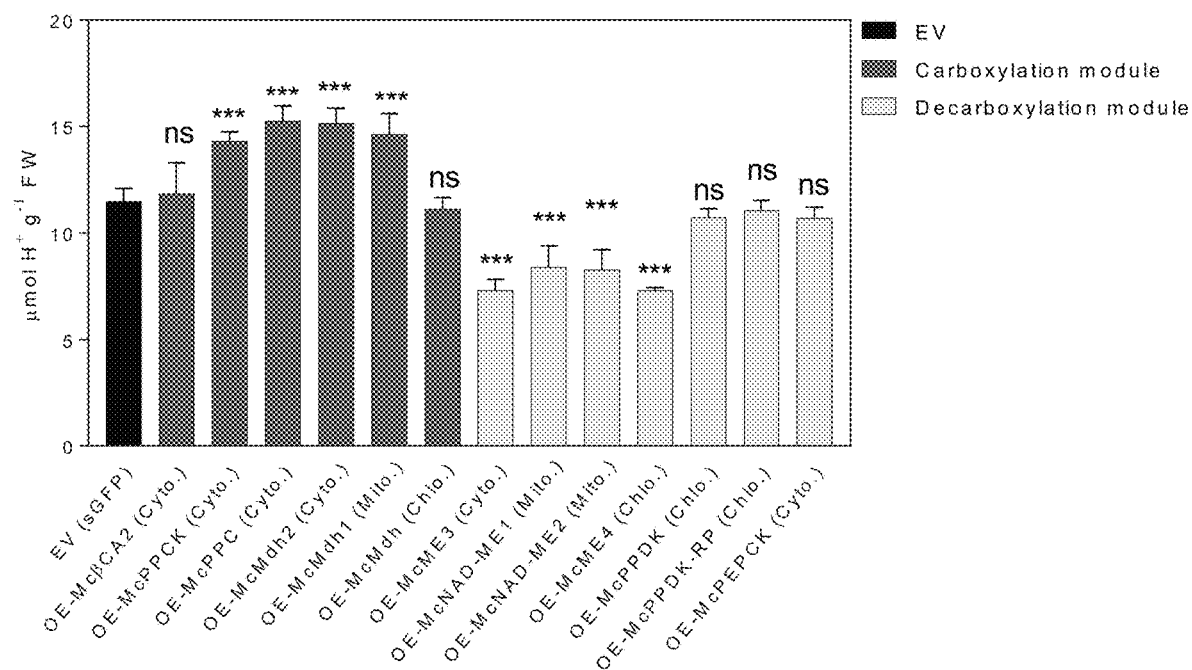
FIG. 25 illustrates overexpression of core ice plant CAM gene alters malate content in *Arabidopsis*.

FIG. 25 illustrates overexpression of core ice plant CAM gene alters malate content in *Arabidopsis*. T3 homozygous seeds of 35S::sGFP Empty Vector (EV) control, 35S::McβCA2-sGFP, 35S::McPPCK1-sGFP, 35S::McPPC1-sGFP, 35S::McNAD-Mdh2-sGFP, 35S::McNADP-Mdh1-sGFP, or 35S::McNAD-Mdh-sGFP, 35S::McNADP-ME3-sGFP, 35S::McNAD-ME1-sGFP, 35S::McNAD-ME2-sGFP, 35S::McNAD-ME4-sGFP, 35S::McPPDK-sGFP, 35S::McPPDK-RP-sGFP, and 35S::McPEPCK-sGFP were germinated and grown in soil mix under a 12-h photoperiod. Titratable acidity was measured using 4-week-old leaf. Values represent means±s.d., ns=non-significant and ***p<0.001. One-way ANOVA with Dunnett's multiple comparison test. n=10.

Figure 26:
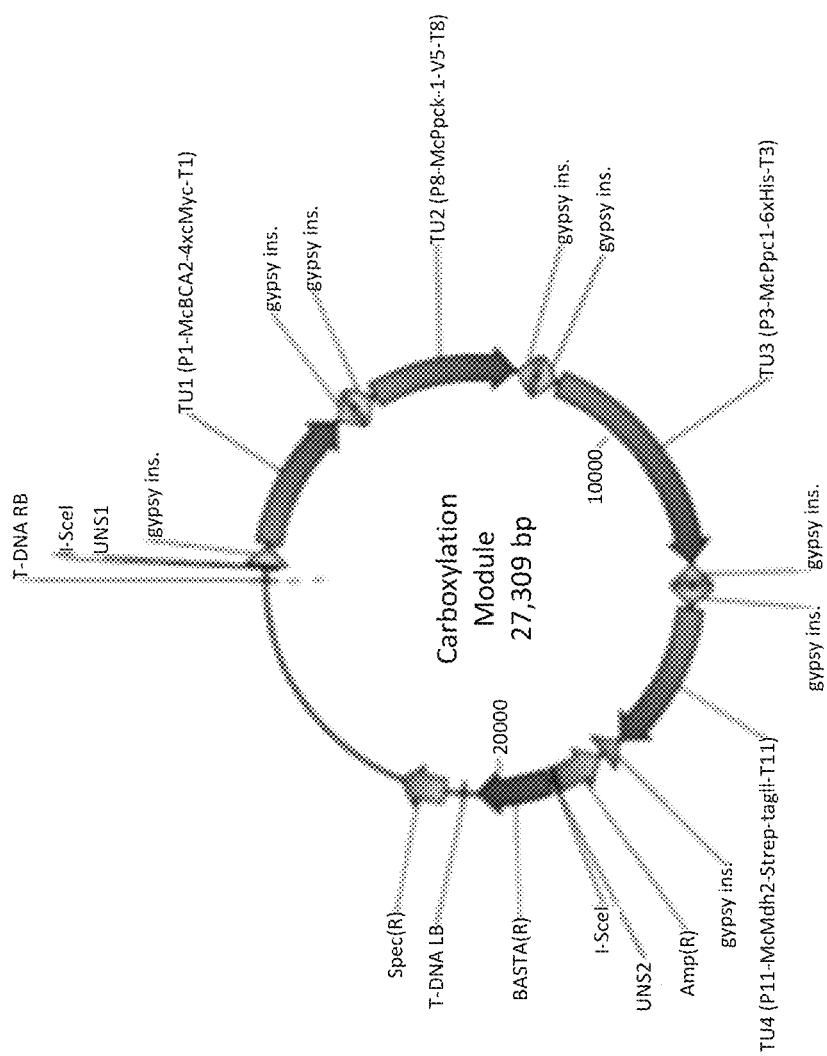
FIG. 26 provides a schematic representation of the carboxylation module gene cassette.

FIG. 26 provides a schematic representation of the carboxylation module gene cassette. Each transcription gene cassette of P1::McβCA2-4×cMyc, P8::McPPCK1-V5, P3::McPPC1-6×His, and P11::McNAD-Mdh2-Strep-tagII was assembled into one position binary vector 1 via Gibson assembly. The entire sequence of carboxylation module cassette is presented in SEQ ID NO.: 211.

FIGS. 27A-27E illustrates engineered carboxylation module synergistically increase overall plant biomass. *Agrobacterium* strain GV3101 harboring the carboxylation module was transformed into *Arabidopsis*. T3 homozygous seeds of 35S::sGFP Empty Vector (EV) control, 35S::McβCA2-sGFP, 35S::McPPCK1-sGFP, 35S::McPPC1-sGFP, 35S::McNAD-Mdh2-sGFP, and the T2 carboxylation module were germinated and grown in soil mix under a 12-h photoperiod. (27A) Representative images of 5-week-old EV control and the engineered carboxylation module plants. Bar=5 cm (27B) Quantification of rosette diameter (n=10). (27C) Quantification of leaf fresh weight (n=10). (27D) Quantification of leaf dry weight (n=10). (27E) Quantification of leaf number (n=15). Values represent means±s.d., ns=non-significant, *p<0.05, p<0.01, and *p<0.001, One-way ANOVA with Dunnett's multiple comparison test.

Figure 28:
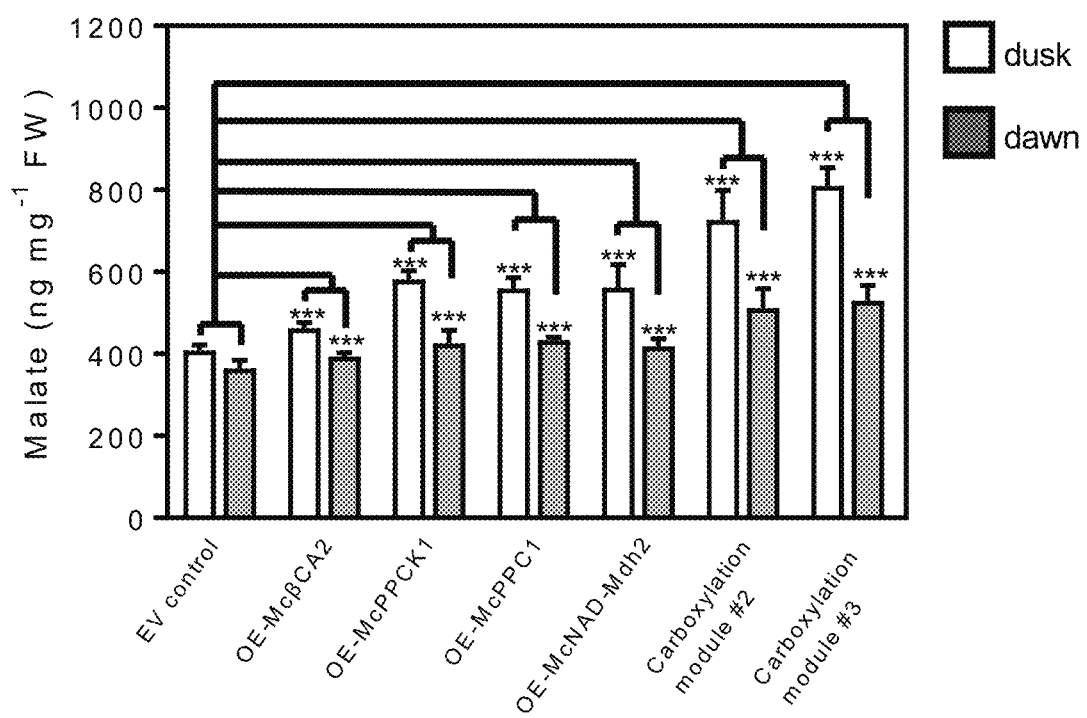
FIG. 28 illustrates engineered carboxylation module increase malate content in *Arabidopsis*.

FIG. 28 illustrates engineered carboxylation module increase malate content in *Arabidopsis*. T3 homozygous seeds of 35S:: sGFP Empty Vector (EV) control, 35S::McβCA2-sGFP, 35S::McPPCK1-sGFP, 35S::McPPC1-sGFP, 35S::McNAD-Mdh2-sGFP, and the T2 carboxylation module #2 and #3 were germinated and grown in soil mix under a 12-h photoperiod for 2 weeks. Leaf malate content was measured at dusk (6:00 pm) and dawn (6:00 am) using colorimetric malate assay kit (Sigma). Values represent means±s.d., ns=non-significant and ***p<0.001, One-way ANOVA with Dunnett's multiple comparison test. n=5

FIGS. 29A and 29B illustrate Engineered carboxylation module increase seed size in *Arabidopsis*. Seeds of 35S::sGFP Empty Vector (EV) control, the T2 carboxylation module #2, and #3 were germinated and grown in soil mix under a 12-h photoperiod. (29A) Representative seed images of EV control and the engineered carboxylation module plants. Bar=1 mm (29B) Quantification of seed size (n=30). Values represent means±s.d., ns=non-significant and ***p<0.001, One-way ANOVA with Dunnett's multiple comparison test.

FIGS. 30A-30D illustrate engineered carboxylation module increases net $CO_2$ assimilation, stomatal conductance, and ROS scavenging capacity under highlight conditions in *Arabidopsis*. Seeds of 35S::sGFP Empty Vector (EV) control and the carboxylation module #2 were germinated and grown in soil mix under a 12-hour photoperiod. Gas exchange data were collected using 4-week-old leaves at photosynthetically active radiation (PAR) levels of 0, 50, 100, 150, 300, 400, 500, 100, 2000, and 3000 µmol $m^{-2}s^{-1}$ (n=5). (30A) Quantification of net $CO_2$ assimilation. (30B) Quantification of stomatal conductance. (30C) Quantification of concentration. (30D) Representative images of leaves after high light treatment.

Figure 31A:
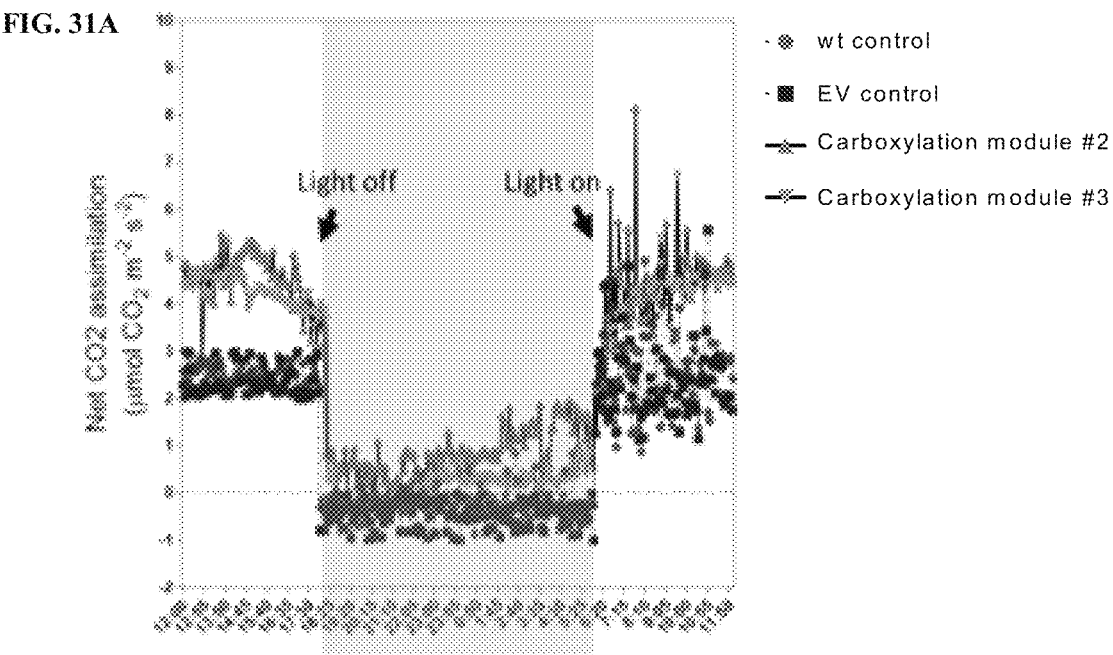
FIGS. 31A and 31B illustrate engineered carboxylation module increases nocturnal net $CO_2$ assimilation and stomatal conductance in *Arabidopsis*.
Figure 31B:
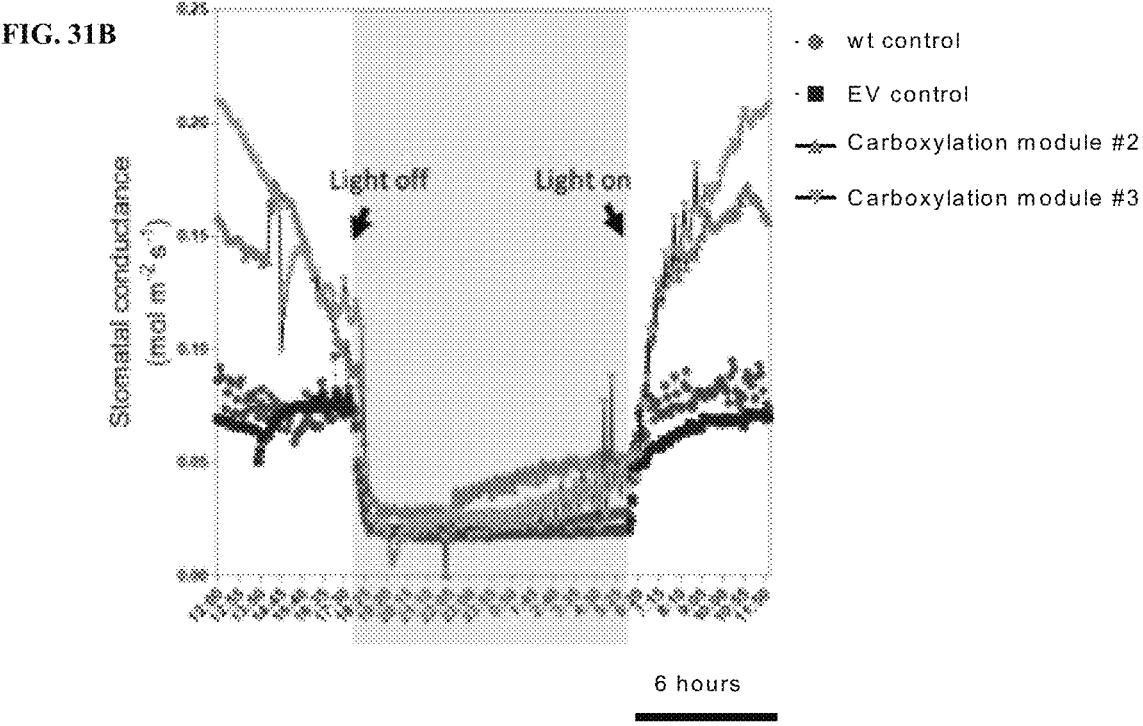

FIGS. 31A and 31B illustrate engineered carboxylation module increases nocturnal net $CO_2$ assimilation and stomatal conductance in *Arabidopsis*. Seeds of wildtype (wt), 35S::sGFP Empty Vector (EV) control, carboxylation module #2 and #3 were germinated and grown in soil mix under a 12-h photoperiod. Gas exchange data were collected using 4-week-old leaves at photosynthetically active radiation (PAR) levels of 0 and 300 µmol $m^{-2}s^{-1}$ for 24 hr. (31A) Net $CO_2$ assimilation. (31B) Stomatal conductance.

In view of the many possible embodiments to which the principles of the disclosed invention may be applied, it should be recognized that the illustrated embodiments are only preferred examples of the invention and should not be taken as limiting the scope of the invention. Rather, the scope of the invention is defined by the following claims. We therefore claim as our invention all that comes within the scope and spirit of these claims.

SEQUENCE LISTING (211 sequences)

SEQ ID NO: 1 - DNA, 852 bp, M. crystallium
atgacaggaggctttaggaaatgcatggtgctttgttgtgcaagaaaactcccgaaagaaacaacaatgggaaccaccgcatacgacgaagccattacagggctgagcaagcttctcagtgagaagaaaggattggatgatgtagcagccgcaaaaatcaagcagttaacagcagagttgcagcagggcaccaagcaaaatggtgtttccgaaaacgggtttgacccggatgagcgcatcaaatccggattcatccggttcaagactgagaaatatgagaagaatcctgctctgtacggtgaacttgccaagggccagagtcccaagttcttggtatttgcctgctcagactcccgtgtttgcccctcccacatcttggatttcaagccaggggatgccttctcggttcgtaacatcgccaacatggtcccaccttttgataagacaaagttctctgggacaggggcagccattgagtatgctgtattgcatctaaatgtggagaatattgtggtcattggacacagctgctgtggaggaataaaggggctcatgtccatccctgattgtggcaccacttccacagacttcattgaagagtgggtcaagatcgctcagcctgctaggaccaaggtcaaagcagaagttagtagcgcagagttcacggagcagtgcaagaactgcgagaaggaagctgtcaatgtctctctcggaaacttgttgacatacccatttgtgagggaagcagtaatgaagaaaactctggcattgaagggtgcacattatgattttgtcaatggacgtttcgagctgtggaacctcgaatttggcctctcaccttctaccgcagta

SEQ ID NO: 2 - DNA, 837 bp, M. crystallium
atgtgtgagagcttcaagagagaataccagctctgcgaggagatcggtcgaggccgcttcggcgtcgtctaccgctgctacaacccctcctccaccgaagattccgacactcctttggctgtcaagtccattgataagcgcctcctcctcgacgacgagaccgaccgtgagtgccttgacaaggaacccaaaatcctccaccttctctctcctcaccctaatattctgcagatccataacctctttgattctgatacccatctcctcattgttaccgatctctgccaagaggagaccctttacgaacgcattatctctaacggccccttctctgagcctgacgctgcggctattttctgtcagctcgccgaggccctcgctcactgccaccgcaactacgtcgctcaccgtgatatcaaaccagacaacatactattcgactcaaggaacaggctgaagctctgcgacttcggctcggccgagtggttcggagcaggagacagagagatgcgcggtgtggtaggaacaccctactacgtggcgccggaggtgctttccggaaaagactacaatgagaaggcggatgtgtggagtgctggtgttattctctacatcatgctcggtggagttccacccttctatggtgagactgttgaggagacttttgaggctgttcttaggggaaatcttcgctttccggccaggattttccgaaacgtttctactcaggcaagggatttgttgaggaagatgatgtgcaaggatgtttccagaaggttttctgctgaacaagtcttaaggcatccttgggtaaccagtggaggattggccaacatg

SEQ ID NO: 3 - DNA, 2898 bp, M. crystallium
atgtcgactgtgaagctagataggcttacgtcgattgatgcccaattgaggctgcttgcacctaagaaggtctctgaggatgataaacttattgagtatgatgctttgctgctcgatcgcttccttgatattcttcaaaacttacatggggaagacatcaaagaaacggttcaagaattgtatgaacaatctgctgaatatgaaaggacacatgaccccaagaaattggaggagctgggaagcatggtgaccagtttggatgctggagattccattgtggttgccaaatcattttctcacatgcttaacctggctaaccttgctgaagaagtccagatttcccgtcgcaagagggtcaaaaaagtgaagaaaggagattttatggatgagaatactgcgatgactgagtcagatatggaagaaacactgcggaggcttattgtggatttgaagaaatccccacaagaaatttttgaaactttgaaaaaccagacagttgacttagttttcacagctcatcctacacaatctgttcgtagatccttgcttcaaaaacatggaaggataagggattgtttggcccaattgtatgccaaagacattactcccgatgataagcaggagcttgatgaggctctgcaaagagagatacaagctgcatttcgtactgatgaaatcaggaggactcagccaactccacaggatgagatgagagctgggatgagctacttccatgagacaatttggaatggtgttccaaaatttttgcgacgtcttgacacggcattgaagaacataggaataactgagcgtgttccctataatgcccctcttattcagttctcatcttggatgggtggtgatcgagatggaaatccgagagtaacacctgaagttactagggatgtatgtttattggctagaatgatggctgctaatatgtatttctcccagatagacgagctcatgtttgagctctcaatgtggagatgcaccgatgaacttcgtgaacgagcagaggaacttcacaaatattcaaagagagactccaaacactacattgagttttggaaacaaattccttccagtgagccttatcgtgttattcttgctgacgtgagggataagctctactatacacgtgaacgttctcgtcagttgttggcaagtgaggtctctgaaatccccgtcgaagcaaccttcaccgaaattgatcagtttctggagcctcttgagctttgctacagatctctctgtgcttgtggtgataggccagttgcggatggaagtcttcttgatttcatgcgacaagtagctacctttgggctttgtcttgtaaagcttgatattaggcaagaatcagagaggcatactgatgtgatggatgccattactacgcacctgggcattgggtcctaccgagactggacagaagagaagaggcaggattggctcttatctgagcttaggggcaagcgccctttgtttggccctgatcttcccagaactgatgaaattgctgatgttttggacacaataaatgtaatcgcagaactcccatctgatagtttcggcgcttatgttatctcgatggctactgccccttctgatgtgcttgctgttgagcttctgcaacgtgaatgtaaagttaaaaagcctttgagggttgttccattgtttgagaaacttgctgacctggaggctgctcctgcttctatgacccgcctattctccgtagattggtataaaaataggattgatgggaagcaagaagtcatgatcggatactctgattctggtaaggatgctggtcgtctctcagccgcttggcaaatgtacaaggttcaggaagagctgcttaaggtttctaagaaatttggggtgaagctcacaatgtttcatggacgaggaggaacggtgggaagaggagggggtcctactcatcttgctattttggcacagccagctgaaactattggtggatcacttcgtgttacaattcaaggtgaagtgattgaacaatcctttggagagcagcacttgtgttttagaacactccagcgttatacagctgctacacttgaacatgggatgaatccaccaaaatctcctaagccagaatggcgtgctctcttggaccagatggctgttgttgccacagaggaataccgctccatagtttttaaggagcctcgatttgtcgagtacttccgtctcgcaacgccagaaacggagtatgggcgcatgaacattgggagcaggccatcaaagagaaagccaagtggtggaattgaatctctccgtgcaatcccttggatctttgcatggactcaaactaggttccatctgcctgtgtggctgggcgttggcggagcacttaaacatgtccttgagaaagatataaggaaccataacatgcttagggacatgtacaacaatttccctttcttcagggtgaccattgatttgcttgaaatggtgttcgctaagggagaccctgaaattgccgctttatatgacaaactactggtgtcagaggagctgcagtcctttggggagcgtttgagggcaaattatgaagacactaaacgccgtctcctcgaggtcgctgggcataaagacctgctagagggagatccttacttgaaacagaggctccgccttcgtgatccctacatcacaaccctcaatgtctgccaagcgtataccctgaagcggattcgtgatcccgacttcaaggtaacagagaggccacacttatccaaggaaatcatggacgcacacaaggcagctgctgagctggtgaagctaaaccccactagtgagtatgctcctggacttgaagacacacttatcttaaccatgaagggtgttgctgctggtctgcagaacactggt

SEQ ID NO: 4 - DNA, 996 bp, M. crystallium
atggccgttgaacctcttcgcgttcttgtcaccggcgccgccgggcaaattgggtatgctctcgttcccatgattgctaggggaataatgctgggtgctaatcagcctgtgatcttgcacatgctcgatattcctccagcagccgaggcattgaacggagtgaaaatggagctggtggatgctgcctttccacttcttaaaggcgttgttgctacaaccgatgctgctgaagcctgcaaaggtgtaaatgttgctgtcatggttggtggcttcccaaggaaagaaggcatggagaggaaggatgtgatgtcaaagaatgtttccatctacaaggctcaagcttctgctcttgagcaacatgctgctcccaattgcaaggttttggttgttgccaaccctgccaacaccaatgctttgatcctaaaggaatttgccccatcaatcccggagaagaacatttcttgtttgacaaggcttgaccacaacagagctctaggtcagatctcagagagattgaatgttcaagtctctgatgttaagaatgtgattatttggggaaaccactcctcaactcaataccctgatgtcaaccacgctaccgtgaaaacacagggtgttgataagcctgttcgtgagcttgttgctgatgatgcatggttgaatggagagttcataacaactgtgcaacagcgtggagctgccatcatcaaggcaaggaagctctccagtgcattgtcagctgctagttctgcttgtgatcacatccatgattgggtgcttggaaccccagagggaacatgggtatctatgggtgtgtattctgatggctcgtacaatgtgccagctggaatcatttactccttcccagtaacttgtaaaaatggagaatggacaatcgtccaagggctgccaattgacgatgactcaaggaagaaaatggatgcaactgctgcagagcttgtcgaggagaagacattggcctactcatgcctgact

SEQ ID NO: 5 - DNA, 1842 bp, M. crystallium
atggcggggaaattcggatcactgaggcagagtttcattgaaagaagcaaagagaggttgctatctcgaagagggtattcggagctagggttacctggctccgatggtgatgttgaagatgagggcaatagcgatgtcaaatgcggttgtttccgatcaatttgcggcgggagaagtcgaaattccgatagcggaaatcgatctaagggcggatgttaccggtggatttgtgatcggatattagggttctgtaatgggtttaaggaagttgcaggtaaattttatgagatgggtcgatctgatcctcgaaaggtgttctttgcagcgaagatgggtgggagcttagctttggtttcaatgctcatcttcttgaggggacctttatcggatattcgtcagtatgctatttgggctattttaactgtcattgtctgtttcgagtacagcgtaggagcatgtcttagtaaaggccttaaccgtggtctgggaacggtaactgctggaagtattgctttcgggctagcagaattagcagttcggtctggtgaatacaaagaaccgctcattattatgtatatgttcttcgcaggttctattgcgacctacattaaattatacccaacaatgaaagaatacgaatatgggtttcgggtattccttatgacatttgccatagtaatggtgactggaaataaaacaacaaattttttccaaactgcttttttccggttgttgcttatttcaattggtgctgtcatagcttcagtggttaacatatgtgtttaccctatttggtctggcaccgatcttcataaggtggtggtgaaaaatttcaagggtgttgctacttctttggaaggctgtttaaatggatacttgcagtgtgtagcgtatgataaaatcccttcaaagattcttacgtaccaagcttatgatgaccctacatatggtggctatagaacagctgtccagtcagcaagtcaagaagaaactctgttgagctttgcgaaatgggagcctcctcatggcccttatagatcatgcaattatccttgggaatcctatgttaaagttagtggggcactgagacattgtgcttttatggttatggcaatgcatggatgcattcttgcagaaatacaggcaccaccagagaagagacaggtttttgccgatgaacttcgcagggttggcatggccggtgctaaagtcatacgtgaacttgggaacaaagttgagaaaatggagaaactaagccccggtgatatacttgcagaagtacatacggcagcagaggagctgcaaatgagaatcgatgagaagtcttatctcctggtcaatttcgagaaatgggaagaaggcaaacgaccaaaggaatttgatgaccctgagcgtgtttctcaaatgaagagttatggaagtggtcagcttgttataaactccctaagtgaagcagtgctaagtattgaacccgagcagatgcaatcatacattgataatatgagttcaagggtttcaatgattggtgctggcccttcattgcaaggtatgttttccactgatagtatggcgactagaactcagtggccttcacgtctttcactcctaccagacctgagcatcaatgaaaaggaagcgaaaacatatgagagcgcaagctccttgtcactagcaacttttgcttcacttctagtagaatttgtggcaagacttggatatttggtggaggcctttgaggaactcagtgagaaagcagctttcaaggagcaaagtgagctagaagacgaaaaggcgagtaatgggctctggcataagttgatggtgtcccttcagttcagaaat

SEQ ID NO: 6 - DNA, 1647 bp, M. crystallium
atgaatcataatcacgatcccaaaactccccttctcccaacccatcatgatgatgatcatcaagggcggccaacacctgagcgttccacctcagttatcatgtcccttgccacacccaacacggccttcgtcctcctaggacccctcttgtgtacccttgtaatgttgtgtgtcaagttcgatgggaccgagtcgagccggaacatgctggctatcctggtctggatcttcacgtggtggctcaccgaggctgttccgatgcctatcacctccatgtcgccgttgtttctatttccggtgtttggtatcgcctcggccgacgctgttgctaagtcgtacatggacgatgtcatctctcttgtgcttggtagcttcattcttgctcttgctgttgagcactacaatattcacaagaggctggccttgaatataacattgttattctgtggggacccagtgaacccaccgttgctcctcctggggatctgcgccaccacagctttcgtcagcatgtggatgcacaacgtggcagccaccgtcatgatgatgccagtggccaccggaatcctccagagatttccatccacaagagaaggcggccgaaacgacgccgttgacaagttcagtagggcagttgtgcttggggtgatatactctgccacaattggtggtatcagcactctgactgggacaggtgtcaacctcatattggctggcatgtggaagagctatttccctcaagcggaccccatcagcttcaacacgtggctcttttatgggttcccattggctgtctttatcttcttctcgttgtgggccatactttgttgtttgtattgcaaacgtgggtcgggccgggtccttcaggagtatttggataaggatcaccttcaaagagagctcgacttgttaggtccaatgtcctttgcagaaaaaatggtattatccgtctttttggggcttattatgctatggatgacaaggaatctaaccgatggtatccctggatggggagctctatttaaagggagggccggtgatggcactgctagtgttatgatggcaactttgttattcataatacccaacaagaggagaaagggagaaaagctaatggactggactaagtgcaagaaactaccttggaacgttgttcttctacttggggccggctttgccatcgcagatggggtgcggtcaagcggcctagcggacgtgctttcccgcgccttggacttcctagagacggctccattttgggcaattgcacccatggtgtgtctcataggtgggatcatgaccgagttcacctccaacaatgccaccacgacattgttggttcctctgttgatccaaattgcacagacgatgcacgtgcatccgcttcttcttatggtccctggagccgttggggcccaattcgccttcttgcttccgactggaactccttccaatatagttgggttcaccactggtcatattgacatcaaggatatgattaaaactggtctccctctaaagattgctgggacagttgtactctcatttttaatgcctacccttggagcctacgtttttgggacaaacaacaaaccgctgatgtacccacaaagttggcgtagtttgtattcaaattcgggatataca

SEQ ID NO: 7 - DNA, 1755 bp, M. crystallium
atgggtggtagcaatgcattgaatgagatgaccaatggatctgatggtattactgggggtgttgctgatgtctatggtgaagagtttgccacccaggatcagcttgtcaccccttggagcttctctgttgcttgtggtcattcattgttgagagatccccagcacaacaaagggcttgcttttacagagaaagagagagatgcccacttcttgcgcggtctgttaccccctgtagttctgtcacaagagctccaggagaagaagttcttgacgactcttcgtcaatatcaagttcccttgcagaaatacatggccatgatggatcttcaggagaggaatgagaaactgttctacaaacttcttgttgaccatgtcgaagaactgcttcctcttgtttatacgccaactgttggtgagggatgccaaaagtatggaagtatttttagacgtccccaggggctattcatcagtttgaaggataagggaagaatccttgagcttttgagaaactggcctgaaaagaaaattcaagttattgtagttactgatggtgaacgcatactggggctaggagaccttggctgtcagggaatgggaatacctgttggaaaactttccttgtattcagcccttggtggagtctgcccatcagcatgcttgcctataacccttgatgttggcaccaacaatcagaagttgttagatgatgaattttacattggattgaagcagaagcgggctactggagaggaatatgctgagtttgtccaagaattcatgtctgcagttaagcaaaactatggggagaagatccttgtacagtttgaagattttgccaaccataacgcatttgagttgctggagaaataccgcaccactcacctcgtcttcaatgatgacattcagggtactgcttctgttgttcttgcaggacttattgcttctttaaaactactagggggaaccttggctgaccataaatttttgttcctcggtgctggagaagctggaacgggtattgcagagcttatagcccttgagatgtcaaagaagacaaaggctccagtagagcagatgaggaaaaagatttggcttgtcgactccaagggacttgttgttagctctaggaaggagacacttcagcagttcaaactaccttgggctcacgaacatgaacccattacaactcttatagatgctgtccaggcaatcaagcccacagtgttgattggtacttctggaaaagggaaacaatttaccaaggaggtcgttgaagccatggcaaatatcaatgcgaaacctctcattcttgctctatcaaatcctacttcacagtcagaatgtactgccgaagaagcctacacatggagtcagggacatgcaatatttgccagtggaagcccatttgaccctgttgaatatgaaggaagaacttttgtccctggccaggcaaataatgcttacattttccctgggtttggtttgggtctgatcatgtgtggtgcaatccgtgtccatgatgacatgctattggctgcctctgaggcactggcttcacaagttacaggagaacatttcataaagggacttatctacccaccattcaaggacatcagaaagatatcagctcacattgctgccggagtagctgcaaaagcttatgaacttggtttggctagtcggcttcctcaaccagccgatcttgttaagtttgccgagagctgcatgtacaaccctacttaccggagtttccgt

SEQ ID NO: 8 - DNA, 2847 bp, M. crystallium
atggcgtcagctttcaaggggatcttgatcagatctccacctgatgtctgtgcagagacagtagcaaaagtgagccaatgcaatcgagctcaacttgttaagaattcgtccactggttttaaaaatatcttcaaattatcagaggccaggaaatttcacgctccagttgcaagtcatttgaggtcacaagccgtcatggccccagcctcagacccaacatcaactgcaataaagagagtattcacctttggtaaaggaaggagtgaaggcaacaagggtatgaagtccttgttgggaggtaaaggagcaaaccttgcagagatggccagcataggcttatccgtcccacctggattgactatttctacagaagcatgccaagagtaccaggagcatggaaaacagctctctgctggtttgtgggaggagatattggagggattgagagtcatagagaaggatatggggtcttaccttggagacccttctaagcctcttctgctttcagttcgttctggtgctgcgatttccatgccagggatgatggacactgtcctcaatctaggacttaatgacgatgtggttgcaggactggcagcaaaaagtggagaacgctttgcttacgactcatacagacgtttcctggacatgtttggtaatgtagtcatgggtatttctcactcatcatttgaagagaagttagaaaagttgaagcaggcaaaaggtgttaaacttgatacggagctaactgcatctgatctaaaagaggtagtagaacagtacaagaacgtctatcttgaagtaaaaggagaaaagtttcctgctgatccagaaagacagcttcagcttgctattcaagcagtatttgattcatgggatagtccaagggccatcaagtatcggaacattaaccagataacaggactgaaagggactgcagttaatatccagtgtatggtgtttggtaacatgggaaatacttcagggactggtgttcttttcactcgaaacccaagcactggtgaaaagaagctctatggggaattcctgattaatgctcagggagaagatgtagttgccggcattagaacgccagaagacttggacaccatgaggagctgcatgcctgaagcttacaaggagcttgtggagaactgtgaaattctggaacgacattacaaggatatgatggatattgaattcactgttcaagaaaataggctatggatgttgcaatgccgatctggtaaacgaactggtaaaggtgctgtgaagatagctgtagacttggtgaaagaaggaatagtcgacacttacactgctattaagatggtggaaccacagcatcttgatcaacttcttcacccacagtttgaagacccatctgcttataaagacagagtgattgctactggcctgccggcatctcctggagctgctgttgggcagattattttcagtgctgatgaagctgaatcatggcaagcacaaggaaagagtgtcattctggtgaggaatgaaactagcccagaggatgttgggggtatgcatgcagcaattggaatcttaactgctaggggtggcatgacatctcatgcagctgttgtagcccgtgggtggggaaaatgttgtgtttcagggtgctctgaaatccgagtgaatgatacagacaaggttcttttggttggagacaaagtaatatcagaaggtgattggctttcacttaatggatctactggtgaagttatcttagggaaagtaccactttcacctcctgctctcagtggggatctagaaaccttcatgtcttgggcggatgatatacgtgtccttaaggtcatggcaaatgctgacacaccagaggatgctttggcagcaagaaacaatggtgctgaaggaattggactttgcaggacagagcacatgttttttgcttcagatgataggattaagacagtgaggaagatgataatggcagtaacatccgaacagagaaaagtggctctggaccagctattgccttatcaaagatccgacttcgaagggatttttcgggcaatggatggtcttccagtgacaattagattgttggaccctccactacatgagttccttcctgaaggtgatgtagaacaaattgtcagtgaacttaccttggagactggcatggctgaagatgaaatcttttccaggattgaaaagttgtcagaggtcaatcctatgttgggtttcagaggctgcaggttggggatatcatacccagaactaactgaaatgcaagcacgggcaatcttccaagctgctgtttcaatgagcaaccagggtgttaaagtttttcctgagataatggttccccttgtaggaacgcctcaggaattaggacatcaagtgagcttgatacggaatgttgcagaaaaggtattctctgagacgggttcctccttgagttacaaggtgggaacaatgattgagatccctagggcggctctggttgcagatgagattgcaatggaagcagaattcttctcttttgggacgaatgatctcacgcaaatgacctttgggtatagcagagatgatgttggcaagttcctccctgtatacttgtccaagggcatacttcagagtgatccatttgaggttttggaccagaaaggtgtgggccaactcatcaaactagcaacggagaagggccgtagtgcaaggcctagcttaaaggttggcatatgtggggagcatggaggagaaccgtcatctgttgcatttttcgcggaagcaggattggactacgtttcatgttcccctttcagggttccaattgcaaggctggcagcagctcaagtcgtt

SEQ ID NO: 9 - DNA, 1209 bp, M. crystallium
atgttagcttgtgctagcctcggcctcccaaaaacccaaccgccaccgccactagtttcaccggcacctgaaccaagccgtccggccccagccccatccgtttctctctcctctgactcagcaacctcacttcctcaggcccaaccccaggcccgaaaattaaagggcagctcaaagctgaacctctggtcaagaaatcgggccatacggtccggccggaaactgaaccggccggctaaaaatacggcccaggccgccgttgaaattgcgaattatcctcgaaccagggtcgatgggtccgattctgacggagaagatgacggcgatattcgagaggggaaggcgatatacatggtgtctgacggaactgggtggacggcggaacacgccgttacggcagctttgggtcagttcgattattgcttggtcgatcatggttgccctgttaatacccatttgttttctgggatagatgatgtagagcgtctgatggaaattgtgaaacaagcagcaaaagaaggtgctatgcttgtctatacgcttgctgattcatcaatggctgaatctgccaaaaaagcctgcaaactgtggggtgttccatcaaccgatgttctgggcccaataacggagtcaattgcttctcatcttggcgcctcaccttcaggactccctcgtggtgctggaggtgtaaatgttcccctaagtgaagactatttccgaagaattgaagccatagagtttaccatcaagcaagatgatggggctcttcctcagaacttgcataaggctgaacttgtactcactggtgtatctcgaactggaaaaactccactatcaatttacctggcacaaaaaggatacaaagtggcaaatgttccaatcgtaatgggtgtggatttaccaaaaactctgtttgagatagaccctgataaggtttttggtttgactataaatccggtaatcttgcaatcaattaggaagtcacgagccaagagcctgggattagctgaagatgagacgactagctattctgaaatggactatgtgagaggcgagttggtgaacgcgactaaaatcttctcacaaaatcctaagtggcgggtcgttgaggtgactagtaaagccattgaagaatctgcagcagttatcttgaggctgtaccatgacagaaagcagaagtgtttgatgcccagaatatctaagcgctat

SEQ ID NO: 10 - DNA, 80 bp, Artificial Sequence
  Synthesized DNA sequence upstream of position binding vector
aagcttattaccctgttatccctaaccggtttaccgagctcttattggttttcaaacttcattgactgtgcccctgcagg

SEQ ID NO: 11 - DNA, 80 bp, Artificial Sequence
  Synthesized DNA sequence upstream of position binding vector
aagcttattaccctgttatccctaaccggtgcgtttttatgcttgtagtattgtataatgtttttaagatcccctgcagg

SEQ ID NO: 12 - DNA, 80 bp, Artificial Sequence
  Synthesized DNA sequence upstream of position binding vector
aagcttattaccctgttatccctaaccggtctaatacccaatctctcgtcttatccagatgttttatacgcccctgcagg

SEQ ID NO: 13 - DNA, 80 bp, Artificial Sequence
  Synthesized DNA sequence upstream of position binding vector
aagcttattaccctgttatccctaaccggtgaattcccttatgtgagtgtaaaaggcaggcgagtttgtccccctgcagg

SEQ ID NO: 14 - DNA, 80 bp, Artificial Sequence
  Synthesized DNA sequence upstream of position binding vector
aagcttattaccctgttatccctaaccggttgcttgcaaaagcagtaattggaaagcactctcaaagaatcccctgcagg

SEQ ID NO: 15 - DNA, 11376 bp, Artificial Sequence
  A synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtttaccgagctcttattggttttcaaacttcattgactgtgcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagctgaacgagaaacgtaaaatgatataaatatcaatatattaaattagattttgcataaaaaacagactacataatactgtaaaacacaacatatccagtcactatggcggcccctcgaggggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtgcgtttttatgcttgtagtattgtataatgtttttaagatccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 16 - DNA, 11376 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtgcgtttttatgcttgtagtattgtataatgtttttaagatcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagctgaacgagaaacgtaaaatgatataaatatcaatatattaaattagattttgcataaaaaacagactacataatactgtaaaacacaacatatccagtcactatggcggcccctcgaggggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtctaatacccaatctctcgtcttatccagatgttttatacgccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 17 - DNA, 11376 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtctaatacccaatctctcgtcttatccagatgttttatacgcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagctgaacgagaaacgtaaaatgatataaatatcaatatattaaattagattttgcataaaaaacagactacataatactgtaaaacacaacatatccagtcactatggcggcccctcgaggggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtgaattcccttatgtgagtgtaaaaggcaggcgagtttgtcccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 18 - DNA, 11376 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtgaattcccttatgtgagtgtaaaaggcaggcgagtttgtccccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagctgaacgagaaacgtaaaatgatataaatatcaatatattaaattagattttgcataaaaaacagactacataatactgtaaaacacaacatatccagtcactatggcggcccctcgaggggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggttgcttgcaaaagcagtaattggaaagcactctcaaagaatccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 19 - DNA, 11376 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggttgcttgcaaaagcagtaattggaaagcactctcaaagaatcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagctgaacgagaaacgtaaaatgatataaatatcaatatattaaattagattttgcataaaaaacagactacataatactgtaaaacacaacatatccagtcactatggcggcccctcgaggggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtagataagttgatttagccataaaatattgtttccgtgaccccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 20 - DNA, 11376 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtagataagttgatttagccataaaatattgtttccgtgacccccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagctgaacgagaaacgtaaaatgatataaatatcaatatattaaattagattttgcataaaaaacagactacataatactgtaaaacacaacatatccagtcactatggcggcccctcgaggggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggttctgagtcacggcttcattggcattccgtacaacgaacgtccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 21 - DNA, 11376 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggttctgagtcacggcttcattggcattccgtacaacgaacgtcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagctgaacgagaaacgtaaaatgatataaatatcaatatattaaattagattttgcataaaaaacagactacataatactgtaaaacacaacatatccagtcactatggcggcccctcgaggggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtcctcagagagcctatagcggtaaaacaacaccatgcatccccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 22 - DNA, 11376 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtcctcagagagcctatagcggtaaaacaacaccatgcatcccccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagctgaacgagaaacgtaaaatgatataaatatcaatatattaaattagattttgcataaaaaacagactacataatactgtaaaacacaacatatccagtcactatggcggcccctcgaggggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtcgcagtcgcttcctgtaaatagagcattaaattccatagtccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 23 - DNA, 11376 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtcgcagtcgcttcctgtaaatagagcattaaattccatagtcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagctgaacgagaaacgtaaaatgatataaatatcaatatattaaattagattttgcataaaaaacagactacataatactgtaaaacacaacatatccagtcactatggcggcccctcgaggggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtacttaatcgaaaaaaaaacagacagccatgtgctcttcggccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 24 - DNA, 11376 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtacttaatcgaaaaaaaaacagacagccatgtgctcttcggcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagctgaacgagaaacgtaaaatgatataaatatcaatatattaaattagattttgcataaaaaacagactacataatactgtaaaacacaacatatccagtcactatggcggcccctcgaggggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtggacatgattatggaacacacacacgctagccgcccagttccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 25 - DNA, 11376 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtggacatgattatggaacacacacacgctagccgcccagttcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagctgaacgagaaacgtaaaatgatataaatatcaatatattaaattagattttgcataaaaaacagactacataatactgtaaaacacaacatatccagtcactatggcggcccctcgaggggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtgagcccaaacagcgaaatacctgagcgaacaaatactactccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 26 - DNA, 5408 bp, Artificial Sequence
  Synthetic DNA vector
aagcttggtgcgtttttatgcttgtagtattgtataatgtttttaagatccttaattaaggtgcgtttttatgcttgtagtattgtataatgtttttaagatcctagggataacagggtaatgagctcggatccactagtaacggccgccagtgtgctggaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattctgcagatatccatcacactggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 27 - DNA, 5408 bp, Artificial Sequence
  Synthetic DNA vector
aagcttggtctaatacccaatctctcgtcttatccagatgttttatacgccttaattaaggtgcgtttttatgcttgtagtattgtataatgtttttaagatcctagggataacagggtaatgagctcggatccactagtaacggccgccagtgtgctggaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattctgcagatatccatcacactggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 28 - DNA, 5408 bp, Artificial Sequence
  Synthetic DNA vector
aagcttggtgaattcccttatgtgagtgtaaaaggcaggcgagtttgtcccttaattaaggtgcgtttttatgcttgtagtattgtataatgtttttaagatcctagggataacagggtaatgagctcggatccactagtaacggccgccagtgtgctggaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattctgcagatatccatcacactggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 29 - DNA, 5408 bp, Artificial Sequence
  Synthetic DNA vector
aagcttggttgcttgcaaaagcagtaattggaaagcactctcaaagaatccttaattaaggtgcgtttttatgcttgtagtattgtataatgtttttaagatcctagggataacagggtaatgagctcggatccactagtaacggccgccagtgtgctggaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattctgcagatatccatcacactggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 30 - DNA, 5408 bp, Artificial Sequence
  Synthetic DNA vector
aagcttggtagataagttgatttagccataaaatattgtttccgtgaccccttaattaaggtgcgtttttatgcttgtagtattgtataatgtttttaagatcctagggataacagggtaatgagctcggatccactagtaacggccgccagtgtgctggaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattctgcagatatccatcacactggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 31 - DNA, 5408 bp, Artificial Sequence
  Synthetic DNA vector
aagcttggttctgagtcacggcttcattggcattccgtacaacgaacgtccttaattaaggtgcgtttttatgcttgtagtattgtataatgtttttaagatcctagggataacagggtaatgagctcggatccactagtaacggccgccagtgtgctggaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattctgcagatatccatcacactggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 32 - DNA, 5408 bp, Artificial Sequence
  Synthetic DNA vector
aagcttggtcctcagagagcctatagcggtaaaacaacaccatgcatccccttaattaaggtgcgtttttatgcttgtagtattgtataatgtttttaagatcctagggataacagggtaatgagctcggatccactagtaacggccgccagtgtgctggaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattctgcagatatccatcacactggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 33 - DNA, 5408 bp, Artificial Sequence
  Synthetic DNA vector
aagcttggtcgcagtcgcttcctgtaaatagagcattaaattccatagtccttaattaaggtgcgtttttatgcttgtagtattgtataatgtttttaagatcctagggataacagggtaatgagctcggatccactagtaacggccgccagtgtgctggaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattctgcagatatccatcacactggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 34 - DNA, 5408 bp, Artificial Sequence
  Synthetic DNA vector
aagcttggtacttaatcgaaaaaaaaacagacagccatgtgctcttcggccttaattaaggtgcgtttttatgcttgtagtattgtataatgtttttaagatcctagggataacagggtaatgagctcggatccactagtaacggccgccagtgtgctggaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattctgcagatatccatcacactggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 35 - DNA, 5408 bp, Artificial Sequence
  Synthetic DNA vector
aagcttggtggacatgattatggaacacacacacgctagccgcccagttccttaattaaggtgcgtttttatgcttgtagtattgtataatgtttttaagatcctagggataacagggtaatgagctcggatccactagtaacggccgccagtgtgctggaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattctgcagatatccatcacactggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 36 - DNA, 5408 bp, Artificial Sequence
  Synthetic DNA vector
aagcttggtgagcccaaacagcgaaatacctgagcgaacaaatactactccttaattaaggtgcgtttttatgcttgtagtattgtataatgtttttaagatcctagggataacagggtaatgagctcggatccactagtaacggccgccagtgtgctggaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattctgcagatatccatcacactggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 37 - DNA, 5855 bp, Artificial Sequence
  Synthetic DNA vector
aagcttggtgcgtttttatgcttgtagtattgtataatgtttttaagatccttaattaaggtgcgtttttatgcttgtagtattgtataatgtttttaagatcctagggataacagggtaatgagctcggatccactagtctcacaattccacacaacatacgagccggaagcataaagtgtaaagcctggggtgcctaatgagtgagctaactcacattaggctgaattaggcgcgcctatttctattaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgggggatcgatcccgcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaatgccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcttattgccccccgggatcagatctggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctgatccgtcgagattaatagaaataaattcagcctaattcggcgttaattcagtacattaaaaacgtccgcaatgtggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 38 - DNA, 5855 bp, Artificial Sequence
  Synthetic DNA vector
aagcttggtctaatacccaatctctcgtcttatccagatgttttatacgccttaattaaggtgcgtttttatgcttgtagtattgtataatgtttttaagatcctagggataacagggtaatgagctcggatccactagtctcacaattccacacaacatacgagccggaagcataaagtgtaaagcctggggtgcctaatgagtgagctaactcacattaggctgaattaggcgcgcctatttctattaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgggggatcgatcccgcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaatgccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcttattgccccccgggatcagatctggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctgatccgtcgagattaatagaaataaattcagcctaattcggcgttaattcagtacattaaaaacgtccgcaatgtggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 39 - DNA, 5855 bp, Artificial Sequence
  Synthetic DNA vector
aagcttggtgaattcccttatgtgagtgtaaaaggcaggcgagtttgtcccttaattaaggtgcgtttttatgcttgtagtattgtataatgtttttaagatcctagggataacagggtaatgagctcggatccactagtctcacaattccacacaacatacgagccggaagcataaagtgtaaagcctggggtgcctaatgagtgagctaactcacattaggctgaattaggcgcgcctatttctattaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgggggatcgatcccgcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaatgccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcttattgccccccgggatcagatctggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctgatccgtcgagattaatagaaataaattcagcctaattcggcgttaattcagtacattaaaaacgtccgcaatgtggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 40 - DNA, 5855 bp, Artificial Sequence
  Synthetic DNA vector
aagcttggttgcttgcaaaagcagtaattggaaagcactctcaaagaatccttaattaaggtgcgtttttatgcttgtagtattgtataatgtttttaagatcctagggataacagggtaatgagctcggatccactagtctcacaattccacacaacatacgagccggaagcataaagtgtaaagcctggggtgcctaatgagtgagctaactcacattaggctgaattaggcgcgcctatttctattaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgggggatcgatcccgcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaatgccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcttattgccccccgggatcagatctggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctgatccgtcgagattaatagaaataaattcagcctaattcggcgttaattcagtacattaaaaacgtccgcaatgtggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 41 - DNA, 5855 bp, Artificial Sequence
  Synthetic DNA vector
aagcttggtagataagttgatttagccataaaatattgtttccgtgaccccttaattaaggtgcgtttttatgcttgtagtattgtataatgtttttaagatcctagggataacagggtaatgagctcggatccactagtctcacaattccacacaacatacgagccggaagcataaagtgtaaagcctggggtgcctaatgagtgagctaactcacattaggctgaattaggcgcgcctatttctattaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgggggatcgatcccgcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaatgccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcttattgccccccgggatcagatctggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctgatccgtcgagattaatagaaataaattcagcctaattcggcgttaattcagtacattaaaaacgtccgcaatgtggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 42 - DNA, 5855 bp, Artificial Sequence
  Synthetic DNA vector
aagcttggttctgagtcacggcttcattggcattccgtacaacgaacgtccttaattaaggtgcgtttttatgcttgtagtattgtataatgtttttaagatcctagggataacagggtaatgagctcggatccactagtctcacaattccacacaacatacgagccggaagcataaagtgtaaagcctggggtgcctaatgagtgagctaactcacattaggctgaattaggcgcgcctatttctattaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgggggatcgatcccgcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaatgccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcttattgccccccgggatcagatctggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctgatccgtcgagattaatagaaataaattcagcctaattcggcgttaattcagtacattaaaaacgtccgcaatgtggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 43 - DNA, 5855 bp, Artificial Sequence
  Synthetic DNA vector
aagcttggtcctcagagagcctatagcggtaaaacaacaccatgcatccccttaattaaggtgcgtttttatgcttgtagtattgtataatgtttttaagatcctagggataacagggtaatgagctcggatccactagtctcacaattccacacaacatacgagccggaagcataaagtgtaaagcctggggtgcctaatgagtgagctaactcacattaggctgaattaggcgcgcctatttctattaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgggggatcgatcccgcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaatgccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcttattgccccccgggatcagatctggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctgatccgtcgagattaatagaaataaattcagcctaattcggcgttaattcagtacattaaaaacgtccgcaatgtggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 44 - DNA, 5855 bp, Artificial Sequence
  Synthetic DNA vector
aagcttggtcgcagtcgcttcctgtaaatagagcattaaattccatagtccttaattaaggtgcgtttttatgcttgtagtattgtataatgtttttaagatcctagggataacagggtaatgagctcggatccactagtctcacaattccacacaacatacgagccggaagcataaagtgtaaagcctggggtgcctaatgagtgagctaactcacattaggctgaattaggcgcgcctatttctattaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgggggatcgatcccgcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaatgccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcttattgccccccgggatcagatctggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctgatccgtcgagattaatagaaataaattcagcctaattcggcgttaattcagtacattaaaaacgtccgcaatgtggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 45 - DNA, 5855 bp, Artificial Sequence
  Synthetic DNA vector
aagcttggtacttaatcgaaaaaaaaacagacagccatgtgctcttcggccttaattaaggtgcgtttttatgcttgtagtattgtataatgtttttaagatcctagggataacagggtaatgagctcggatccactagtctcacaattccacacaacatacgagccggaagcataaagtgtaaagcctggggtgcctaatgagtgagctaactcacattaggctgaattaggcgcgcctatttctattaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgggggatcgatcccgcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaatgccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcttattgccccccgggatcagatctggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctgatccgtcgagattaatagaaataaattcagcctaattcggcgttaattcagtacattaaaaacgtccgcaatgtggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 46 - DNA, 5855 bp, Artificial Sequence
  Synthetic DNA vector
aagcttggtggacatgattatggaacacacacacgctagccgcccagttccttaattaaggtgcgtttttatgcttgtagtattgtataatgtttttaagatcctagggataacagggtaatgagctcggatccactagtctcacaattccacacaacatacgagccggaagcataaagtgtaaagcctggggtgcctaatgagtgagctaactcacattaggctgaattaggcgcgcctatttctattaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgggggatcgatcccgcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaatgccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcttattgccccccgggatcagatctggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctgatccgtcgagattaatagaaataaattcagcctaattcggcgttaattcagtacattaaaaacgtccgcaatgtggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 47 - DNA, 5855 bp, Artificial Sequence
  Synthetic DNA vector
aagcttggtgagcccaaacagcgaaatacctgagcgaacaaatactactccttaattaaggtgcgtttttatgcttgtagtattgtataatgtttttaagatcctagggataacagggtaatgagctcggatccactagtctcacaattccacacaacatacgagccggaagcataaagtgtaaagcctggggtgcctaatgagtgagctaactcacattaggctgaattaggcgcgcctatttctattaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgggggatcgatcccgcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaatgccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcttattgccccccgggatcagatctggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctgatccgtcgagattaatagaaataaattcagcctaattcggcgttaattcagtacattaaaaacgtccgcaatgtggcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 48 - DNA, 5284 bp, Artificial Sequence
  Synthetic DNA vector
aagcttggtgcgtttttatgcttgtagtattgtataatgtttttaagatccttaattaaggtgcgtttttatgcttgtagtattgtataatgtttttaagatcctagggataacagggtaatgagctcggatccactagttcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccagcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 49 - DNA, 5284 bp, Artificial Sequence
  Synthetic DNA vector
aagcttggttgcttgcaaaagcagtaattggaaagcactctcaaagaatccttaattaaggtgcgtttttatgcttgtagtattgtataatgtttttaagatcctagggataacagggtaatgagctcggatccactagttcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccagcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 50 - DNA, 5284 bp, Artificial Sequence
  Synthetic DNA vector
aagcttggtctaatacccaatctctcgtcttatccagatgttttatacgccttaattaaggtgcgtttttatgcttgtagtattgtataatgtttttaagatcctagggataacagggtaatgagctcggatccactagttcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccagcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 51 - DNA, 5284 bp, Artificial Sequence
  Synthetic DNA vector
aagcttggtgaattcccttatgtgagtgtaaaaggcaggcgagtttgtcccttaattaaggtgcgtttttatgcttgtagtattgtataatgtttttaagatcctagggataacagggtaatgagctcggatccactagttcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccagcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 52 - DNA, 5284 bp, Artificial Sequence
  Synthetic DNA vector
aagcttggtagataagttgatttagccataaaatattgtttccgtgaccccttaattaaggtgcgtttttatgcttgtagtattgtataatgtttttaagatcctagggataacagggtaatgagctcggatccactagttcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccagcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 53 - DNA, 5284 bp, Artificial Sequence
  Synthetic DNA vector
aagcttggttctgagtcacggcttcattggcattccgtacaacgaacgtccttaattaaggtgcgtttttatgcttgtagtattgtataatgtttttaagatcctagggataacagggtaatgagctcggatccactagttcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccagcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 54 - DNA, 5284 bp, Artificial Sequence
  Synthetic DNA vector
aagcttggtcctcagagagcctatagcggtaaaacaacaccatgcatccccttaattaaggtgcgtttttatgcttgtagtattgtataatgtttttaagatcctagggataacagggtaatgagctcggatccactagttcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccagcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 55 - DNA, 5284 bp, Artificial Sequence
  Synthetic DNA vector
aagcttggtcgcagtcgcttcctgtaaatagagcattaaattccatagtccttaattaaggtgcgtttttatgcttgtagtattgtataatgtttttaagatcctagggataacagggtaatgagctcggatccactagttcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccagcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 56 - DNA, 5284 bp, Artificial Sequence
  Synthetic DNA vector
aagcttggtacttaatcgaaaaaaaaacagacagccatgtgctcttcggccttaattaaggtgcgtttttatgcttgtagtattgtataatgtttttaagatcctagggataacagggtaatgagctcggatccactagttcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccagcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 57 - DNA, 5284 bp, Artificial Sequence
  Synthetic DNA vector
aagcttggtggacatgattatggaacacacacacgctagccgcccagttccttaattaaggtgcgtttttatgcttgtagtattgtataatgtttttaagatcctagggataacagggtaatgagctcggatccactagttcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccagcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 58 - DNA, 5284 bp, Artificial Sequence
  Synthetic DNA vector
aagcttggtgagcccaaacagcgaaatacctgagcgaacaaatactactccttaattaaggtgcgtttttatgcttgtagtattgtataatgtttttaagatcctagggataacagggtaatgagctcggatccactagttcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccagcggccgcggtatcactagtattacagaggtaagttataacagtcgcctaacctctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatc

SEQ ID NO: 59 - DNA, 8500 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctttagggataacagggtaatggtttaccgagctcttattggttttcaaacttcattgactgtgccttaattaaatatccagtcactatggcggcccctcgaggggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttaattaaggtatcactagtattacagaggtaagttataacagtcgcctaaccgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 60 - DNA, 12593 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtttaccgagctcttattggttttcaaacttcattgactgtgcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttagatttctatcaatgaaagtagacgttaaaaaaaaaaaaagatatcacagtacgtggaaacacgtgacacatattttaaagggaaaatataaacgtgaaatgcgtggaaactggcaagtagactattaatatttatgggcctatagtggttatatcaggctttattgggctctctatacgaattaaaagcctcaaacaaataatagaacttgaattgtaggcttttgtacccaccaaactggccgccggtgaccccctctcacgccgtatctctttttctttttcttgtttttttttttttttttttttttttttttttttgtgtgcgcgtatttgtttcaccatcaaaaaattaattttgttttaagtgttttattttccttcgttttgtttaaagtgtttaaaatcgttagttcaatgttgaaaaatatacaataatagaaacaattgtgacttttgtaatttgaatgaacaaaacatataacaataagtcctataatataaacattttaatttacattttcaactttttctcattttaaatttttattcagttgaaggcttgaagcgttggactactttagagaaactttacaagaacgttcttaacatctttttttctttcctttttgaatatcaaaatcagttaaaaacacttttgatctcacagaaactgatacaaagccgacggaaccgaccagattaggtcaaaaacgtaaaagacgcgcaaaaagaaaagaaaataactcataatagaatgttttagtcagaagaaaaaagtacaatatgaccaacgtaaacaaaaaagatgttgacgacataaagaaaagagctacagagacaaaggcattaaaatatcttttgtcgaaatctgaagatatttccttaagcgcgtttgcttctctgtctcctccattccattctatatcatctctgtctttgctctaagctttcctgtcaaaacaaaaattcaattccccacgtctgtcttatccacaataaaaccgaccttagcttagcttagactcattactcatttcacaaaaacagagagagaaatagagagacatactttacaggtaataattatcttgtttaattgtattatatatctctaactaaatttgggataaaaattgtctattcttgatcattcctctctgtatctctctgcttttgacaccttctcttagctgttttttcatcttttatctctgtttttaaaatcttttggctctttcgaagggtttcgagtccttttgagttctttgggcttcctcccaaatttctccacgagctcgacccctttcgtatcttccttctcatttttttgccaaatttattcgatccgtctttcactacaactttgtatacaaaagttgtaatgacaggaggctttaggaaatgcatggtgctttgttgtgcaagaaaactcccgaaagaaacaacaatgggaaccaccgcatacgacgaagccattacagggctgagcaagcttctcagtgagaagaaaggattggatgatgtagcagccgcaaaaatcaagcagttaacagcagagttgcagcagggcaccaagcaaaatggtgtttccgaaaacgggtttgacccggatgagcgcatcaaatccggattcatccggttcaagactgagaaatatgagaagaatcctgctctgtacggtgaacttgccaagggccagagtcccaagttcttggtatttgcctgctcagactcccgtgtttgcccctcccacatcttggatttcaagccaggggatgccttctcggttcgtaacatcgccaacatggtcccaccttttgataagacaaagttctctgggacaggggcagccattgagtatgctgtattgcatctaaatgtggagaatattgtggtcattggacacagctgctgtggaggaataaaggggctcatgtccatccctgattgtggcaccacttccacagacttcattgaagagtgggtcaagatcgctcagcctgctaggaccaaggtcaaagcagaagttagtagcgcagagttcacggagcagtgcaagaactgcgagaaggaagctgtcaatgtctctctcggaaacttgttgacatacccatttgtgagggaagcagtaatgaagaaaactctggcattgaagggtgcacattatgattttgtcaatggacgtttcgagctgtggaacctcgaatttggcctctcaccttctaccgcagtaaacccaacttttctatacaaagttgtaatggaacaaaagcttatttctgaggaagatcttaacggtgaacaaaagcttatttctgaggaagatcttaacggacttgatggagaacaaaagcttatttctgaggaagatcttaacggagaacaaaagcttatttctgaggaagatcttaacggttctgcttagacaactttgtataataaagttgtattcttctgtgcaatagcaacaatggaagattgggttcggtttcagttgttgccataccgtataaatgtgttcttaaagagagtctttttgtcgaggcttttcttcagttgggatgtatatgttttattaaggtgatgagtagtgatttggtgtgtcttttcaaatgctttgtggagtctgtttttccttataaaaatttattctaaatctggtttgtattttgggggtcttctttgctctttcttcattaacagaatactaattataagcttttcatatacaaaccttgaaaggaattttcatcagttactaattcgatttcagagaaatgaatcattcaaaacacttgattagagaaatgcttcttgaaccgggtcggtttaacgaaatccactggctggaaaaattatgcttttatatatataagaagcacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtgcgtttttatgcttgtagtattgtataatgtttttaagatccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 61 - DNA, 12675 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtgcgtttttatgcttgtagtattgtataatgtttttaagatcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttaaccgcttaatatcgtatgattagtattaaaaatcttctccagaatttcaacgttgtttttgctactcacgcattgtaccttaaatgatcttattcatcatttctaacaaaacaatttatgcattcttcgccagtagaagaacctagtagagtgctatcggcaacaactccgtcttgttcatgcggatgcaaaagaagacgtccatgcccacgtccacgtccatgtccacctccacgtccacactattcaagaaattatacagacccttgaaaaagaagaatgaagaagagaaaacaaggatcaattatgggattggtacaatatagttgagggtattgtctaatgtagtacttttgaatatgcttatagatttagacatattaaagactattttctccttttaaatcaatgaagaaaatacttgagttcaatccttcttttgcctttgcataaccgtctctcatccacaccaacaaaacaaatcccagaaccttcttttgcagaattttaaagacacacaaagcaatgaataagaacacttggtttacaataacgatcgaaactggtttacaataatgaccgaatatggtttgcaaatatagatgaattggaatttaattgattcgatctatatctaaaattaaatttcttgggttccctaaatactatcctcttagggtttagatttctattatcaaaactctcgtttaatttgagcaaattggttaatcggagaggttagggaaaacaacgttttctggtataaagagacgagagaaacggtattgatggagttaaaagtgatgatgttgatgaaatactgagtcaacgttaataaggcaagagccgactgtgagaagcaaggtttcatggttgggaattttgttgcgcaacggagaagatgaagtgaattttgttgcgcaacggatttccgcaagcttttcccgagaaaacaaagatatcatctacattctatttttgtgctgtaacttttctgaattttttgtaaacaattttttgtgatatatatatatatataaacaattttatatcattaagtatggtactctttaatgtttttaacggaacatgaccaaaactgctagtgaaagcattttgtcttaactttacaaaagaagttatcttttttttaacacaaactggttttcttcggtaaataaaaagactaagtttgtaaatttattcttagacaattatttactattattgccgactaatatgaaaatgcaaagaagtcgtatttggcattatccaaaagaagggacaaaacacttatctcttaaaacttaaattttaagccattcgtttaccaacaatgaatcttgtggctgatgtagaaaccgcgttcacttgtcaacatttagaaataatgttggctttcaaagaattaaatagaaacaaccaaaatgtatgaggttgagcgtcttctatatatttattacaagacttgcgatgaccaaaaacgcaacgaagaacgaaacaactttgtatacaaaagttgtaatgtgtgagagcttcaagagagaataccagctctgcgaggagatcggtcgaggccgcttcggcgtcgtctaccgctgctacaacccctcctccaccgaagattccgacactcctttggctgtcaagtccattgataagcgcctcttcctcgacgacgagaccgaccgtgagtgccttgacaaggaacccaaaatcctccaccttctctctcctcaccctaatattctgcagatccataacctctttgattctgatacccatctcctcattgttaccgatctctgccaagaggagaccctttacgaacgcattatctctaacggccccttctctgagcctgacgctgcggctattttctgtcagctcgccgaggccctcgctcactgccaccgcaactacgtcgctcaccgtgatatcaaaccagacaacatactattcgactcaaggaacaggctgaagctctgcgacttcggctcggccgagtggttcggagcaggagacagagagatgcgcggtgtggtaggaacaccctactacgtggcgccggaggtgctttccggaaaagactacaatgagaaggcggatgtgtggagtgctggtgttattctctacatcatgctcggtggagttccacccttctatggtgagactgttgaggagacttttgaggctgttcttaggggaaatcttcgctttccggccaggattttccgaaacgtttctactcaggcaagggatttgttgaggaagatgatgtgcaaggatgtttccagaaggttttctgctgaacaagtcttaaggcatccttgggtaaccagtggaggattggccaacatgaacccaacttttctatacaaagttgtaatggaaggaaagcctattcctaatcctcttcttggacttgattctacttgaacaactttgtataataaagttgtatactttgagtttgagttactctgtgttcgaattttaaagtatatgtggttttctgttttagtttcgtgtctcaactctcaagtgtagaggaatgttataaactactatgcaatgaaggaactaatacttatgatggtattttactaattatgttattattcataattccatgcattagagccaattgtcgcattttttttctttcagaattcttcaaacttgtcaaatcgaaatctcttctttagaagcgactagattagtttttttcttcaaaagaaattctctactgaatttataatttaaagagttcacgagctgcctactaaaatatgaaaaatatttatgaatccagcaatacaaattgtagctttgcaatacaagaaagaacaacttttcatagagatcaaaaacgctagataaaaaaaaaacggggaagactaactagtaagtaccacgagtataacacattttttggatttagtttctatgattgctttcgccacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtctaatacccaatctctcgtcttatccagatgttttatacgccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 62 - DNA, 14460 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtctaatacccaatctctcgtcttatccagatgttttatacgcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttactgaaatttagtagagaaaaatatatgtttttttctacatacagaatagtttgaatttttaaaatcggatttgaattttaaaaatagaaatagtgtttgtaagtaaaaaatatattgtactatttaagatgtatagaaataaaatattgttctatactattttcataactgatttgtaaatcaattttaattttagtatagagcaaaatgttttaaatataaagtaatagtgttggtagtggtgatgagatagtagtttatgttacgttaatatagcattataatcaattaaatgtttttgttggaaggatactaaaccctaagtggataatatattgggaacccaaagatttcaatctaaaatttaatattctttaaccatagaaaaatagaataatatatgtttgtcatcactaccaacataacgagtagcacagcacaagatagtctcttggtagaggaaagaagtggtagtagagaacaccgggtacaccatttgggttccacaatcgagggcacaaggagacacgaactcgccacacttaactagaaattgatgtaactccaaaaaaatccaaaattttacctttgtaaatcaaaacccccaattcaatttaatcacaaaccctagacgtcaattccaaaaattaaatgtattgattccgtcgccaatacatctccattgaacgttttcagaatccgaagctttacaaaaaggagatagtaatttttgggacccaaaaagctgttggaatgttaacagctgatgagaaagtgttttttggaaagagagaagaagaagaagaaaaagagcctgtatctcaggcaaagggtagcattgtcattattacagaaaatacaaataatatcagtatctttttgtgggatggttagttacttaattataatttttttgtagattaaaaactcaaatttctcaaaattatactctcctaagtagaaaaattttacaagtttgatttcttgaaaattgatattataatttatttttctgattagggtgggaagattctttataatttttttggtttacctgaaaatgaaagaaaagattgtaagaaagatacaacaagtgtagactggatcttttaaagtccaaaccaaaagccaaaaattaggtaacctaaatatgtaagactttattttttggtttttcttattaaaacaacatttcgataattcattatgatattttttacgctatgatcctcagccttaaactttcattcgtatagaaggataatatcataatagtacaactcttttaattgccaccaatcaactttattgtctgctttcaaaaattttattttttataaaatattattcattttagctataactcaatttggaacttttattcgtcccaaataaaatatctttccaagagagatggaaaaatagcttcatatagagatattttcaacaacttgtccctctctaaactcatccaccttccaaaacagagaaggggaaaatacaactttgtatacaaaagttgtaatgtcgactgtgaagctagataggcttacgtcgattgatgcccaattgaggctgcttgcacctaagaaggtctctgaggatgataaacttattgagtatgatgctttgctgctcgatcgcttccttgatattcttcaaaacttacatggggaagacatcaaagaaacggttcaagaattgtatgaacaatctgctgaatatgaaaggacacatgaccccaagaaattggaggagctgggaagcatggtgaccagtttggatgctggagattccattgtggttgccaaatcattttctcacatgcttaacctggctaaccttgctgaagaagtccagatttcccgtcgcaagagggtcaaaaaagtgaagaaaggagattttatggatgagaatactgcgatgactgagtcagatatggaagaaacactgcggaggcttattgtggatttgaagaaatccccacaagaaatttttgaaactttgaaaaaccagacagttgacttagttttcacagctcatcctacacaatctgttcgtagatccttgcttcaaaaacatggaaggataagggattgtttggcccaattgtatgccaaagacattactcccgatgataagcaggagcttgatgaggctctgcaaagagagatacaagctgcatttcgtactgatgaaatcaggaggactcagccaactccacaggatgagatgagagctgggatgagctacttccatgagacaatttggaatggtgttccaaaatttttgcgacgtcttgacacggcattgaagaacataggaataactgagcgtgttccctataatgcccctcttattcagttctcatcttggatgggtggtgatcgagatggaaatccgagagtaacacctgaagttactagggatgtatgtttattggctagaatgatggctgctaatatgtatttctcccagatagacgagctcatgtttgagctctcaatgtggagatgcaccgatgaacttcgtgaacgagcagaggaacttcacaaatattcaaagagagactccaaacactacattgagttttggaaacaaattccttccagtgagccttatcgtgttattcttgctgacgtgagggataagctctactatacacgtgaacgttctcgtcagttgttggcaagtgaggtctctgaaatccccgtcgaagcaaccttcaccgaaattgatcagtttctggagcctcttgagctttgctacagatctctctgtgcttgtggtgataggccagttgcggatggaagtcttcttgatttcatgcgacaagtagctacctttgggctttgtcttgtaaagcttgatattaggcaagaatcagagaggcatactgatgtgatggatgccattactacgcacctgggcattgggtcctaccgagactggacagaagagaagaggcaggattggctcttatctgagcttaggggcaagcgccctttgtttggccctgatcttcccagaactgatgaaattgctgatgttttggacacaataaatgtaatcgcagaactcccatctgatagtttcggcgcttatgttatctcgatggctactgccccttctgatgtgcttgctgttgagcttctgcaacgtgaatgtaaagttaaaaagcctttgagggttgttccattgtttgagaaacttgctgacctggaggctgctcctgcttctatgacccgcctattctccgtagattggtataaaaataggattgatgggaagcaagaagtcatgatcggatactctgattctggtaaggatgctggtcgtctctcagccgcttggcaaatgtacaaggttcaggaagagctgcttaaggtttctaagaaatttggggtgaagctcacaatgtttcatggacgaggaggaacggtgggaagaggagggggtcctactcatcttgctattttggcacagccagctgaaactattggtggatcacttcgtgttacaattcaaggtgaagtgattgaacaatcctttggagagcagcacttgtgttttagaacactccagcgttatacagctgctacacttgaacatgggatgaatccaccaaaatctcctaagccagaatggcgtgctctcttggaccagatggctgttgttgccacagaggaataccgctccatagtttttaaggagcctcgatttgtcgagtacttccgtctcgcaacgccagaaacggagtatgggcgcatgaacattgggagcaggccatcaaagagaaagccaagtggtggaattgaatctctccgtgcaatcccttggatctttgcatggactcaaactaggttccatctgcctgtgtggctgggcgttggcggagcacttaaacatgtccttgagaaagatataaggaaccataacatgcttagggacatgtacaacaatttccctttcttcagggtgaccattgatttgcttgaaatggtgttcgctaagggagaccctgaaattgccgctttatatgacaaactactggtgtcagaggagctgcagtcctttggggagcgtttgagggcaaattatgaagacactaaacgccgtctcctcgaggtcgctgggcataaagacctgctagagggagatccttacttgaaacagaggctccgccttcgtgatccctacatcacaaccctcaatgtctgccaagcgtataccctgaagcggattcgtgatcccgacttcaaggtaacagagaggccacacttatccaaggaaatcatggacgcacacaaggcagctgctgagctggtgaagctaaaccccactagtgagtatgctcctggacttgaagacacacttatcttaaccatgaagggtgttgctgctggtctgcagaacactggtaacccaacttttctatacaaagttgtaatgtctcatcatcatcatcatcatgcttagacaactttgtataataaagttgtagattcatagatcatatatatgtacatcatatccctctttagagcaggtactcgtgttcacctgcaaatgtaacaaagaacattatactatacaacaaatatacacattgaattatacctgtataaccaacataggtcaagattacatcatacgtgggctaggcccattttatattggcccaataagtgagtgactaaatcctttcgttcccaaatatatctccaccgatcaagagattcatcttccacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtgaattcccttatgtgagtgtaaaaggcaggcgagtttgtcccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 63 - DNA, 12799 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtgaattcccttatgtgagtgtaaaaggcaggcgagtttgtccccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttaaaagaagagagaggaaggagaagagaagaaaaagaagagagacacaacggagcgccaagaggctgatgaacacgtcaccgtacacgtgtcatgatcttgaagggtttgcaaagggaacgcatatgctgagctggcaaccctagatctgcgctggacattttaaatatctgacttaaataatgattggtacacgtagtcataatcgccaccgttcatcttgagatctctacgtagacttgacgtgctgctgattttattccttttaaataatgaaaatacagaattaaactataatgtataattcatttgagatccacagatgacgaaacgtggactaccaaatcaagcatatttgtttttaccatttaatcgacggctaatattgatttcatctacggtaaaatatatctttttttaaccagaaaaaggttagagtggtccccactgtaggatctactgacttgtgtcggccgttagtggttttataaagctgacgtgtcccactgaataaggaataccgttgtggtccctacggacaacgtgggattcgacgccagctcattttttaattttttcttgaaatcttttttaaaattttagacgatgactcaatcttcgccacgtaggatccacccaataaaaaagggttaacaaaatcttatctttaatgctaaattagttgagattaatccatgttgtttaaatccgaaatgatgcatataatcttgtttcttataatcattaagatttagactgaagatctaattccaatttaagagagtcactaaaaaaagaatgaattcaatttcagacaaatccgacaaggtcaaggtgacgtgttcttgatgccaattctagtgggagccacttgacgcgtgcagttagactcccggtccaagacataaatttacgttaataccctcctttattgggttattattgggccgtagttgaattattagacccaacctttttatcctgttcttgattggcacatactttgcaaaaagttaacaaaataacttttattgcaaggcattacaagagaaatgtcaaatttggttgttgcatacatgacatcttattcatatccaatccataaattgatgtgttgttattcaaactggtcttttgatgtattgttagacatatctcatatatattgaacccttggaatcaatataatagattgggctttatttatcttttattgggcttaaagggaattgttggactaaaaaaaccattaaggctataacacactaattacacgtacaatgagagtgagagtcacggacgggatgattacaagaatcatatagcaccaaatatctcatcctcactctcacatacaaacacacattttgttcacacagagatagacacaactttgtatacaaaagttgtaatggccgttgaacctcttcgcgttcttgtcaccggcgccgccgggcaaattgggtatgctctcgttcccatgattgctaggggaataatgctgggtgctaatcagcctgtgatcttgcacatgctcgatattcctccagcagccgaggcattgaacggagtgaaaatggagctggtggatgctgcctttccacttcttaaaggcgttgttgctacaaccgatgctgctgaagcctgcaaaggtgtaaatgttgctgtcatggttggtggcttcccaaggaaagaaggcatggagaggaaggatgtgatgtcaaagaatgtttccatctacaaggctcaagcttctgctcttgagcaacatgctgctcccaattgcaaggttttggttgttgccaaccctgccaacaccaatgctttgatcctaaaggaatttgccccatcaatcccggagaagaacatttcttgtttgacaaggcttgaccacaacagagctctaggtcagatctcagagagattgaatgttcaagtctctgatgttaagaatgtgattatttggggaaaccactcctcaactcaataccctgatgtcaaccacgctaccgtgaaaacacagggtgttgataagcctgttcgtgagcttgttgctgatgatgcatggttgaatggagagttcataacaactgtgcaacagcgtggagctgccatcatcaaggcaaggaagctctccagtgcattgtcagctgctagttctgcttgtgatcacatccatgattgggtgcttggaaccccagagggaacatgggtatctatgggtgtgtattctgatggctcgtacaatgtgccagctggaatcatttactccttcccagtaacttgtaaaaatggagaatggacaatcgtccaagggctgccaattgacgatgactcaaggaagaaaatggatgcaactgctgcagagcttgtcgaggagaagacattggcctactcatgcctgactaacccaacttttctatacaaagttgtaatggctggatctactggagcttcttggtctcatcctcaatttgaaaagggaggaggttctggaggtggatctggtggaggatcatggtctcatccacagttcgaaaagggagctggatctaggcctatttgaacaactttgtataataaagttgtactttgtataagatcattagttgttaattttttaaatatgaatttctaaactatccaccaactaagcatgttgtgacaagcaaaagtatatagataattagatattatatgtatatgtttaaaattgcgtaatatgctttacaggtcgattgttctcctaatcatttgattcttcttaatttattggattacgaaatgacatttctttgtcacctttttcgtgcatatcagatttgtttaaagtttacgtgacgaatgacgattgatcttttatcttgttgtgccgccgtattttgtatggacattacttgtaatactatatatatcagctatgcgttaactatactcatcaaataccacatatgatttattatatcaaagtacttattaataaataattaaattaaccttatattcaattgcacttgggtgagaaagccgttagaaaaaactcccgctatagaagaaatgtggtagatttgaaccgaaattaaatattttcacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggttgcttgcaaaagcagtaattggaaagcactctcaaagaatccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 64 - DNA, 13071 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggttgcttgcaaaagcagtaattggaaagcactctcaaagaatcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttactctttctaatttcaggttataatttattaattttggcggagtaaaagtagatgaccgttacaagtctgatttattagactgtgaaattggaccgttgttatgtgggccatggcttttattaaaaaaagaagagaaggtatattatttaaattggagataatgggccgttttaaacccaattattattggtccactaaagtttttatatcctctaacttcgacgagcttgatatagttttggaccttttggtgtgaacggtcacattcaactaaattaaaaagtccaacaaacaaaatctggtcatgaaaagcttggtgtgatgtttctaataagtaaatttactgaggttaattggttggtttaacttaaatgtaatccaaactcctctccctttagagattttcagttgggaatgaaaacctttaaagcttgcaccctaaaatgacattaatggttatagatatagtttgttttcatgtttcttttttttttatattttcctttagttttttctagggttgggactaaataatcggactcggatccgagatccgatttgaaaagctggatacccaattgggatggatccgcttccggatcctgaatttttagattcagatgaatatttttttttaaactaaagaaagcatatcagcatcacatttttgtggtgatactgcttcaagaatctgtcacatatctgtccaaaagaaaagaatttgtcacatattgtataattttaatatatttattgttttagtttgaaaacaaacgtggaaaaaaacatcttacaggtgtcaggtgtgccgcgtcgtcccactcaaagcctatatcatcaattttctggctgttctaatctactcaatttatttttttattgttaatttactgaagatcggcgacaactttgtatacaaaagttgtaatggcggggaaattcggatcactgaggcagagtttcattgaaagaagcaaagagaggttgctatctcgaagagggtattcggagctagggttacctggctccgatggtgatgttgaagatgagggcaatagcgatgtcaaatgcggttgtttccgatcaatttgcggcgggagaagtcgaaattccgatagcggaaatcgatctaagggcggatgttaccggtggatttgtgatcggatattagggttctgtaatgggtttaaggaagttgcaggtaaattttatgagatgggtcgatctgatcctcgaaaggtgttctttgcagcgaagatgggtgggagcttagctttggtttcaatgctcatcttcttgaggggacctttatcggatattcgtcagtatgctatttgggctattttaactgtcattgtctgtttcgagtacagcgtaggagcatgtcttagtaaaggccttaaccgtggtctgggaacggtaactgctggaagtattgctttcgggctagcagaattagcagttcggtctggtgaatacaaagaaccgctcattattatgtatatgttcttcgcaggttctattgcgacctacattaaattatacccaacaatgaaagaatacgaatatgggtttcgggtattccttatgacatttgccatagtaatggtgactggaaataaaacaacaaattttttccaaactgcttttttccggttgttgcttatttcaattggtgctgtcatagcttcagtggttaacatatgtgtttaccctatttggtctggcaccgatcttcataaggtggtggtgaaaaatttcaagggtgttgctacttctttggaaggctgtttaaatggatacttgcagtgtgtagcgtatgataaaatcccttcaaagattcttacgtaccaagcttatgatgaccctacatatggtggctatagaacagctgtccagtcagcaagtcaagaagaaactctgttgagctttgcgaaatgggagcctcctcatggcccttatagatcatgcaattatccttgggaatcctatgttaaagttagtggggcactgagacattgtgcttttatggttatggcaatgcatggatgcattcttgcagaaatacaggcaccaccagagaagagacaggtttttgccgatgaacttcgcagggttggcatggccggtgctaaagtcatacgtgaacttgggaacaaagttgagaaaatggagaaactaagccccggtgatatacttgcagaagtacatacggcagcagaggagctgcaaatgagaatcgatgagaagtcttatctcctggtcaatttcgagaaatgggaagaaggcaaacgaccaaaggaatttgatgaccctgagcgtgtttctcaaatgaagagttatggaagtggtcagcttgttataaactccctaagtgaagcagtgctaagtattgaacccgagcagatgcaatcatacattgataatatgagttcaagggtttcaatgattggtgctggcccttcattgcaaggtatgttttccactgatagtatggcgactagaactcagtggccttcacgtctttcactcctaccagacctgagcatcaatgaaaaggaagcgaaaacatatgagagcgcaagctccttgtcactagcaacttttgcttcacttctagtagaatttgtggcaagacttggatatttggtggaggcctttgaggaactcagtgagaaagcagctttcaaggagcaaagtgagctagaagacgaaaaggcgagtaatgggctctggcataagttgatggtgtcccttcagttcagaaataacccaacttttctatacaaagttgtaatggcttctatgactggtggacagcaaatgggtgcttagacaactttgtataataaagttgtaaggttgaagaataagaattaaaaaattgtatttaaactataaaatatgcatacataataaattttgatcgtttttaactaataaaacatatggtgtatcatttcaatctcacatgaattaaatcttggtgtgtatagactatacagtatagtagtttgttttgtaaaccgaaatcagaacactggctgctggccggtttacttaatttatgaatctatatatacatttttgcagtcattttgtgaaataaatcctgtagttgggacttatttacaatggctgccactggattttaatgtttgtttttgataattagaaaaaaaatcttcgaattaaatattttacatttaacaatcttccctaaatctctccacattaactacacggttagttactaaaattaaacttccaaaatatttaatatcatttaattactacaaaattatcatttttgatattgtttttctccatgactataacaattcgactataatcatcaacacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtagataagttgatttagccataaaatattgtttccgtgaccccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 65 - DNA, 13506 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtagataagttgatttagccataaaatattgtttccgtgacccccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttattaataaattagtaatgaacacctagactcgtatcttctaatctcaatgtttaatgaatggtaaaaataattatttaattttccgtggtcaacaatgcataatctttttatttattttgtcttcttacctttcaaaaatttctcaacttgtcaacagaaaaaataaaaatcccaataacaaaggtgacaaccgaaacagaagcacatgaccacaatgctaaagatggataaaaaaaatagagcaaaaagaaagacaaaaatttcagtagtcaagagtataattaagcacgtataatttgcaaaatttttattttatttttatgaaccgtttggtgtatatatataatccttgctttccagttttgatgatctttttgtgctactttgtatgcggttaaagattgttgtaataggcaaagaaatcttaagtaatgcctcagctgttaaacgttgtgatctcctctgttcaaaatatttcaagttgatcttacttatggtaatgctctactcgtgattgtgagtttgaactagtcactgttaaggttttctttataattgattgtcaagctaatgaataagtttgtgaatgaggttttagaaagatgcatgattggaagttgtgtttagtaaatgcttctcattacaactagaatttactatagaatcatagaacggccataaccaaacttcatgagtccggtgatattattggaatagaattcacataattttcatacttttgttacttagactgtctacataatgccacataatgaaaatttgaattagaaaacttgaatactaaatctacagatatttcaagtgacttctaatgtatgacaataagacattaagaccccttccatatcatgaccatttcaaactcgtgtcaatatgtaacccatttatcgtgggccataaacccaaaataataaatcatgtatataaacgggctattgggccataaactagtgataataagctttggggcgacgatctctggatacgtcacccctcgcgatacaattacaaccgatcaaggtcagcgaatactccgacatccttttcttgcggcccacatcggtctttagtgaatcacatgttttttctattgtcgtttcttgcgcatcaagttctgctgaggtttcttgttattttatttttgaaatttttcaacacctttaacttatctcgattttgtttaccacttaaaaaacgcccaaccaatggcatacactgaaaatgttttctaaacatttaatatttctgtggctaccaaaaagaaatcaagagttattttccatttattctgggtgaaagagaaacagagtgccacctgtcatttcctaatctggcacgtaggtttttctcatacgtattacagtgaataatacagtataccaaaggcggctcgtagcagagtttgttcgattctcttaaccacattaggtttggagtattatttgcttctctcgattgaagaagagtacctaaagaatcacaactttgtatacaaaagttgtaatgaatcataatcacgatcccaaaactccccttctcccaacccatcatgatgatgatcatcaagggcggccaacacctgagcgttccacctcagttatcatgtcccttgccacacccaacacggccttcgtcctcctaggacccctcttgtgtacccttgtaatgttgtgtgtcaagttcgatgggaccgagtcgagccggaacatgctggctatcctggtctggatcttcacgtggtggctcaccgaggctgttccgatgcctatcacctccatgtcgccgttgtttctatttccggtgtttggtatcgcctcggccgacgctgttgctaagtcgtacatggacgatgtcatctctcttgtgcttggtagcttcattcttgctcttgctgttgagcactacaatattcacaagaggctggccttgaatataacattgttattctgtggggacccagtgaacccaccgttgctcctcctggggatctgcgccaccacagctttcgtcagcatgtggatgcacaacgtggcagccaccgtcatgatgatgccagtggccaccggaatcctccagagatttccatccacaagagaaggcggccgaaacgacgccgttgacaagttcagtagggcagttgtgcttggggtgatatactctgccacaattggtggtatcagcactctgactgggacaggtgtcaacctcatattggctggcatgtggaagagctatttccctcaagcggaccccatcagcttcaacacgtggctcttttatgggttcccattggctgtctttatcttcttctcgttgtgggccatactttgttgtttgtattgcaaacgtgggtcgggccgggtccttcaggagtatttggataaggatcaccttcaaagagagctcgacttgttaggtccaatgtcctttgcagaaaaaatggtattatccgtctttttggggcttattatgctatggatgacaaggaatctaaccgatggtatccctggatggggagctctatttaaagggagggccggtgatggcactgctagtgttatgatggcaactttgttattcataatacccaacaagaggagaaagggagaaaagctaatggactggactaagtgcaagaaactaccttggaacgttgttcttctacttggggccggctttgccatcgcagatggggtgcggtcaagcggcctagcggacgtgctttcccgcgccttggacttcctagagacggctccattttgggcaattgcacccatggtgtgtctcataggtgggatcatgaccgagttcacctccaacaatgccaccacgacattgttggttcctctgttgatccaaattgcacagacgatgcacgtgcatccgcttcttcttatggtccctggagccgttggggcccaattcgccttcttgcttccgactggaactccttccaatatagttgggttcaccactggtcatattgacatcaaggatatgattaaaactggtctccctctaaagattgctgggacagttgtactctcatttttaatgcctacccttggagcctacgtttttgggacaaacaacaaaccgctgatgtacccacaaagttggcgtagtttgtattcaaattcgggatatacaaacccaacttttctatacaaagttgtaatggactacaaagaccatgacggtgattataaagatcatgacatcgattacaaggatgacgatgacaagtgaacaactttgtataataaagttgtatccatatcccctccacttcgccacgtgcttcttcttctctatgtctctatcttgttcactttatgacctctaatcagttgaaatcatatgttgtttacttggaacaattcaatgaaattcagcattttagaaagacagggtattgactttgaaattgaatcatctggtttgactgatagtcaatttaaatggtattaacttttgactaagcacagttagttttcaacatttttaaaattgaacaattaaattgaaaaaacctataagctatggttaaagattgattagtaaaaaatgtttgcttttgcataagagtagaaaaagttttatgggtttaatattttttgtatcaaacatttgaaatatttcttgtatatctgtaaaattattttaaaatatctattataagatttatatgagttttccacttccacatgattcatgtgatacagaaagtgcatctcaaaacttctagagtttccctaccaaaaaaaaaaaaccacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggttctgagtcacggcttcattggcattccgtacaacgaacgtccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 66 - DNA, 13534 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggttctgagtcacggcttcattggcattccgtacaacgaacgtcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttaagcttatagcgtagagatgattcactgatgttagtttcattcctatggaataacaaaatgcttttgatggtatcttcatgaacatgtacgttcacaactatctttgtagctctataactatttggtaactccggtttaagcaaagttctacactttaataatatcgacttcgttaatatatacaaatgaaaatagtcttatagatgcgagagcaaatgtttgagggtaggttaaaggaatcttgagatatggataaacgacactaagttgtgtcgtagcgagacagatccaaactacgacaagtagtaaacggagataataatatccaaaccataagaatccatgaaagcaagtagacaactgcgactttgcctcaccagtcaccatactaataattggagaggtggatctcttaggaatatttacttttataaaagatcagaggctagtcagaactcagggactaaattttattttcagtagtgacatctttaaaagacaacagagatttataaaactccacgtgtacagaagtgaaacagtctgacatgatgcctgatgctaactaactatgtaagataagacatatcttacatagttagttaccatgtaatagtaagtgataacccaaaaatgcaaaaaaaaacatccaactagaacatgtgatatgtcagtatgtgtatgagatcatgtgcacaataatattatcggtatttgtatgtctagttgtctacactctacagctcttactggaaatagattttgaggaacaagaaatagttgaatgagtcattgctatcttctagattttttttttttctgtcataatatcttctagaattttattacttgggaaagcgatatatgatatattctttttccaaaatttactaattaaaaaaaaaaaaaaaaactaagcactctgtatttattgccatattgaaaatgctctttccaccaatattccttatttgcctcaaatcattactttcggattctactgtcttgaactgtgttcatgtgtgtattccctcatcaatcaccttcaattcatattttcctatttccaaaaataaaaagatacagtatctatgtatttaattatatatcatatcaattatatcataataatcataagatcctttttatcgaaataaaaaaggaaacaaatccaatcatagcaagctttttcttttatttaataaacaaaaataaaaagcttcccgaaatggttaaaatccagaaccactaaagtcaaccaaatttgtcaaattcatccacgtcatcagttccatctataaaacgctcacgccattcgtcaagtcccaaaacaagagtccaccacaactttgtatacaaaagttgtaatgggtggtagcaatgcattgaatgagatgaccaatggatctgatggtattactgggggtgttgctgatgtctatggtgaagagtttgccacccaggatcagcttgtcaccccttggagcttctctgttgcttgtggtcattcattgttgagagatccccagcacaacaaagggcttgcttttacagagaaagagagagatgcccacttcttgcgcggtctgttaccccctgtagttctgtcacaagagctccaggagaagaagttcttgacgactcttcgtcaatatcaagttcccttgcagaaatacatggccatgatggatcttcaggagaggaatgagaaactgttctacaaacttcttgttgaccatgtcgaagaactgcttcctcttgtttatacgccaactgttggtgagggatgccaaaagtatggaagtatttttagacgtccccaggggctattcatcagtttgaaggataagggaagaatccttgagcttttgagaaactggcctgaaaagaaaattcaagttattgtagttactgatggtgaacgcatactggggctaggagaccttggctgtcagggaatgggaatacctgttggaaaactttccttgtattcagcccttggtggagtctgcccatcagcatgcttgcctataacccttgatgttggcaccaacaatcagaagttgttagatgatgaattttacattggattgaagcagaagcgggctactggagaggaatatgctgagtttgtccaagaattcatgtctgcagttaagcaaaactatggggagaagatccttgtacagtttgaagattttgccaaccataacgcatttgagttgctggagaaataccgcaccactcacctcgtcttcaatgatgacattcagggtactgcttctgttgttcttgcaggacttattgcttctttaaaactactagggggaaccttggctgaccataaatttttgttcctcggtgctggagaagctggaacgggtattgcagagcttatagcccttgagatgtcaaagaagacaaaggctccagtagagcagatgaggaaaaagatttggcttgtcgactccaagggacttgttgttagctctaggaaggagacacttcagcagttcaaactaccttgggctcacgaacatgaacccattacaactcttatagatgctgtccaggcaatcaagcccacagtgttgattggtacttctggaaaagggaaacaatttaccaaggaggtcgttgaagccatggcaaatatcaatgcgaaacctctcattcttgctctatcaaatcctacttcacagtcagaatgtactgccgaagaagcctacacatggagtcagggacatgcaatatttgccagtggaagcccatttgaccctgttgaatatgaaggaagaacttttgtccctggccaggcaaataatgcttacattttccctgggtttggtttgggtctgatcatgtgtggtgcaatccgtgtccatgatgacatgctattggctgcctctgaggcactggcttcacaagttacaggagaacatttcataaagggacttatctacccaccattcaaggacatcagaaagatatcagctcacattgctgccggagtagctgcaaaagcttatgaacttggtttggctagtcggcttcctcaaccagccgatcttgttaagtttgccgagagctgcatgtacaaccctacttaccggagtttccgtaacccaacttttctatacaaagttgtaatggaacaaaagcttatttctgaggaagatcttaacggtgaacaaaagcttatttctgaggaagatcttaacggacttgatggagaacaaaagcttatttctgaggaagatcttaacggagaacaaaagcttatttctgaggaagatcttaacggttctgcttagacaactttgtataataaagttgtatttgttatgtaacttattcttctaataaaaaactccgctagttcatatcttgttaagtatttggttagcctaagaaattatatagcttgaggtttcacattttcaatattttttaaaaataatttgggtcaatattgatgttggaaatgaaatcaacggttgaattattgtcgtgtgctgcttgcaccatggtccatgctagatggaccgaccactatttttccaaacagtgcctatcctatcaagtagatattttctgaatacgtagataattgtagaatacaagaaaagaaatatcctctgtggaataaatgaataatatacttttgtcagaaacgttacaagttaaaattccacgactgattgccacgtgtaagcttatctcaaaagggccctacagtaccatgatgacgtcatctcttacaccactctctgaaaaattcctccgccttataaaaaaactcgattatcgtcttcacttagtcacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtcctcagagagcctatagcggtaaaacaacaccatgcatccccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 67 - DNA, 14288 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtcctcagagagcctatagcggtaaaacaacaccatgcatcccccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttagaacagataagtgaagtttctctgcgatttttctaatgttgaatccatcaaactaataagtggtccctaaacctacatagtcgatggtaaaatgtcaataatgtttgaaagtttagataataccctgaaaatgacgagtcccttcgtttacttgtaataatgggtgagaactacgacacagttccatagcaactttcatatttcgagaattaaattatattccgcagcaaatgctatgtccttgtaaagctctgtttttagtctatgaccatacttgtaaaacatgttgtttttttttgtgtgaattaacagttcattcaaaataaaaataaataaataaataatcgaaaatgtaactctgtggttattgtagcttgaaaaaacgaataatcaagtgtgttgttcattctcttcgttcgttgcacactggtatagcttgttgctgtcatctactgctgactccagcgataatgaaacgatcagaaccacgaaatttactagaactcagcttatcggaacttggaaggggaccagatgagtattaggctaattcgtcgtgttgtatttttcaactaatgcgtcagtgtcgtttttattttcaactaatgcgtcagtgtcattagtttcggaaataaacgatatttgttttgtttttgtattgggtcctatatcgagcgagattggcatgtgagttgggttggctagggaaaatggtaaaatctccacattttgttttgaaaatgtgaaaaatacatttttccctacagcggggatatgaatcagtactatttataatgcaagatatgtaaatttaaaagacatcataagaaaaacaaaactacagaatttcgcttaagctttcaaagatatcgatttgaatataatggtgcatttgcggggttcagtttccacggaaccggtaaatttaaaagccaaataccttaaaagagttgtgaaacagggttacaaatatacatagtggattcgtatgaaaaagaagggaggaatgagtcctacacgtagtcacatcacatatgaaagagattgcttttgaaaatcgaatcctcttctaatattaaatctttcaagactggaggttttaaacaagaaaatcaaactcgacaactttgtatacaaaagttgtaatggcgtcagctttcaaggggatcttgatcagatctccacctgatgtctgtgcagagacagtagcaaaagtgagccaatgcaatcgagctcaacttgttaagaattcgtccactggttttaaaaatatcttcaaattatcagaggccaggaaatttcacgctccagttgcaagtcatttgaggtcacaagccgtcatggccccagcctcagacccaacatcaactgcaataaagagagtattcacctttggtaaaggaaggagtgaaggcaacaagggtatgaagtccttgttgggaggtaaaggagcaaaccttgcagagatggccagcataggcttatccgtcccacctggattgactatttctacagaagcatgccaagagtaccaggagcatggaaaacagctctctgctggtttgtgggaggagatattggagggattgagagtcatagagaaggatatggggtcttaccttggagacccttctaagcctcttctgctttcagttcgttctggtgctgcgatttccatgccagggatgatggacactgtcctcaatctaggacttaatgacgatgtggttgcaggactggcagcaaaaagtggagaacgctttgcttacgactcatacagacgtttcctggacatgtttggtaatgtagtcatgggtatttctcactcatcatttgaagagaagttagaaaagttgaagcaggcaaaaggtgttaaacttgatacggagctaactgcatctgatctaaaagaggtagtagaacagtacaagaacgtctatcttgaagtaaaaggagaaaagtttcctgctgatccagaaagacagcttcagcttgctattcaagcagtatttgattcatgggatagtccaagggccatcaagtatcggaacattaaccagataacaggactgaaagggactgcagttaatatccagtgtatggtgtttggtaacatgggaaatacttcagggactggtgttcttttcactcgaaacccaagcactggtgaaaagaagctctatggggaattcctgattaatgctcagggagaagatgtagttgccggcattagaacgccagaagacttggacaccatgaggagctgcatgcctgaagcttacaaggagcttgtggagaactgtgaaattctggaacgacattacaaggatatgatggatattgaattcactgttcaagaaaataggctatggatgttgcaatgccgatctggtaaacgaactggtaaaggtgctgtgaagatagctgtagacttggtgaaagaaggaatagtcgacacttacactgctattaagatggtggaaccacagcatcttgatcaacttcttcacccacagtttgaagacccatctgcttataaagacagagtgattgctactggcctgccggcatctcctggagctgctgttgggcagattattttcagtgctgatgaagctgaatcatggcaagcacaaggaaagagtgtcattctggtgaggaatgaaactagcccagaggatgttgggggtatgcatgcagcaattggaatcttaactgctaggggtggcatgacatctcatgcagctgttgtagcccgtgggtggggaaaatgttgtgtttcagggtgctctgaaatccgagtgaatgatacagacaaggttcttttggttggagacaaagtaatatcagaaggtgattggctttcacttaatggatctactggtgaagttatcttagggaaagtaccactttcacctcctgctctcagtggggatctagaaaccttcatgtcttgggcggatgatatacgtgtccttaaggtcatggcaaatgctgacacaccagaggatgctttggcagcaagaaacaatggtgctgaaggaattggactttgcaggacagagcacatgttttttgcttcagatgataggattaagacagtgaggaagatgataatggcagtaacatccgaacagagaaaagtggctctggaccagctattgccttatcaaagatccgacttcgaagggatttttcgggcaatggatggtcttccagtgacaattagattgttggaccctccactacatgagttccttcctgaaggtgatgtagaacaaattgtcagtgaacttaccttggagactggcatggctgaagatgaaatcttttccaggattgaaaagttgtcagaggtcaatcctatgttgggtttcagaggctgcaggttggggatatcatacccagaactaactgaaatgcaagcacgggcaatcttccaagctgctgtttcaatgagcaaccagggtgttaaagtttttcctgagataatggttccccttgtaggaacgcctcaggaattaggacatcaagtgagcttgatacggaatgttgcagaaaaggtattctctgagacgggttcctccttgagttacaaggtgggaacaatgattgagatccctagggcggctctggttgcagatgagattgcaatggaagcagaattcttctcttttgggacgaatgatctcacgcaaatgacctttgggtatagcagagatgatgttggcaagttcctccctgtatacttgtccaagggcatacttcagagtgatccatttgaggttttggaccagaaaggtgtgggccaactcatcaaactagcaacggagaagggccgtagtgcaaggcctagcttaaaggttggcatatgtggggagcatggaggagaaccgtcatctgttgcatttttcgcggaagcaggattggactacgtttcatgttcccctttcagggttccaattgcaaggctggcagcagctcaagtcgttaacccaacttttctatacaaagttgtaatgtcttggaaagatgcttctggatggtcttgaacaactttgtataataaagttgtaaattgggctaatgattaacatgaatatttttcataagtctaaaaatatgttattctctctctttcaaaatacattgaatttggtattagttacttttatttatttaagtttggtgttaactttagtactttaagccagaattttctttgaaaatctaaacgaccttattttgagaattctttaagaaagtaagtcttgaaacaattcgaacaagcttaagcttagtttcagcttcttattcttccttagtaatttctcttgatcccgtggcaagtagatttattcctttattgtacgtattgatgatgcctcgatcacttagatgagtccttgttaaagggaaccaaacttcaaatccgactatcattttcttattttctggacaaaaagtctaaactcatatattacagatgtttaaaattttgaatagttttgtctttaacgaggagctacactagtaatggaagcttcgtcgattgaaaagaggtcagatgtatccacacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtcgcagtcgcttcctgtaaatagagcattaaattccatagtccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 68 - DNA, 12694 bp, Artificial Sequence
  Synthetic DNA vector
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttattaccctgttatccctaaccggtcgcagtcgcttcctgtaaatagagcattaaattccatagtcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttattttaaatatctgtattttgcctccttttcattctattttgtttgatacaaacgattgtggtttgtaatgttaaaattaggaatgttattgaatgatatgtatatttcataaaaataataataataaaagtaggatgaatagtaaaattccaaggcatttcataatttacccattacatggtcaaaatttatcaatattttaaaataataataatcatccaatcaagattttgggaatagaatatcttaagaacttagtataattacatatatatatatatattcccttttaaatgtatcaaaaacaaactaagaacatacaaggaatttgatgtagtactatacaatttacatgcaaacagatgtagtactatttgatgacaaaaaaaaaaaaaaagatgtagtactattttatcttttcatcggaataattcggtcatgaagctattaattggttttaatgagaatttattataacagttgttgccacactgtcgaaatactaacgcctaacggctagttaaataattaacacgcggtgagaagtgagtgagttacacgaaccactaagaatctaatataggaagataagataagcatttcacacgtgtggtgtggacaatttaacagtgttaacacgcgcatggcatgtgatctagaaattagaacattaattttagcgttttgactttgacctttgaatcactaggcgtaggtatttacacgtgtaacaatataatttttttcaatatgtgatgatcatgggccaacgtttgtgggtaaaggtgtggtgttcgatcatgatccacttaaatttactgaattttagaattataacagcagaaggatataagtaatataccaaacttaactataatctacctctccttgtctatgtatactaaatgtctaacatgtaacacaaagctgtacaaaatttttaactctcaaattttttgaaataatgcaaagctgtaaaaatagctgtacgagaaaactgtacaataaaactgaaaataaaaaaatttgtaacgtttttgataaaagttttgtaaatgtataaccatcaaaactgtacaacttccagctttgataatgaattaccattcaaagctagagtttcgaattttttcattgtatacaaccatttgaacacaactcttttcaattatgccatacatacatttagttaataaattttaccgattaactagtactgacaaaagaaacaaagagtaattatatttttttgataaattgttttattagaaaaatacttaaaattgataaaaataaataaacccaattgatatatttgatattacaataccagatattgaaacaaataagacatgttttgtctatatacttccaactagaagatatttatttatccatatcctagatattttaatgtgtgaatctaatacattctcttatatacgaccaaatagtaaaacaatatgcctctcctgcaatttttcttcatccaatatttctacaactttgtatacaaaagttgtaatgttagcttgtgctagcctcggcctcccaaaaacccaaccgccaccgccactagtttcaccggcacctgaaccaagccgtccggccccagccccatccgtttctctctcctctgactcagcaacctcacttcctcaggcccaaccccaggcccgaaaattaaagggcagctcaaagctgaacctctggtcaagaaatcgggccatacggtccggccggaaactgaaccggccggctaaaaatacggcccaggccgccgttgaaattgcgaattatcctcgaaccagggtcgatgggtccgattctgacggagaagatgacggcgatattcgagaggggaaggcgatatacatggtgtctgacggaactgggtggacggcggaacacgccgttacggcagctttgggtcagttcgattattgcttggtcgatcatggttgccctgttaatacccatttgttttctgggatagatgatgtagagcgtctgatggaaattgtgaaacaagcagcaaaagaaggtgctatgcttgtctatacgcttgctgattcatcaatggctgaatctgccaaaaaagcctgcaaactgtggggtgttccatcaaccgatgttctgggcccaataacggagtcaattgcttctcatcttggcgcctcaccttcaggactccctcgtggtgctggaggtgtaaatgttcccctaagtgaagactatttccgaagaattgaagccatagagtttaccatcaagcaagatgatggggctcttcctcagaacttgcataaggctgaacttgtactcactggtgtatctcgaactggaaaaactccactatcaatttacctggcacaaaaaggatacaaagtggcaaatgttccaatcgtaatgggtgtggatttaccaaaaactctgtttgagatagaccctgataaggtttttggtttgactataaatccggtaatcttgcaatcaattaggaagtcacgagccaagagcctgggattagctgaagatgagacgactagctattctgaaatggactatgtgagaggcgagttggtgaacgcgactaaaatcttctcacaaaatcctaagtggcgggtcgttgaggtgactagtaaagccattgaagaatctgcagcagttatcttgaggctgtaccatgacagaaagcagaagtgtttgatgcccagaatatctaagcgctataacccaacttttctatacaaagttgtaatggatacttatagatatatttgaacaactttgtataataaagttgtaaaccgaatatctcttcgaatcacattcatatatatagagtcttgagagtatacacacttgaaaccgtttgtacatacatatacataccattgtgctatgttactcccaggttttgataccttagttttttttacctgcaaatcgatcaaaacccgattttctttgcggagttaccacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtacttaatcgaaaaaaaaacagacagccatgtgctcttcggccttaattaatagggataacagggtaatactagtggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 69 - DNA, 50188 bp, Artificial Sequence
  Synthetic gene circuit
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctttagggataacagggtaatggtttaccgagctcttattggttttcaaacttcattgactgtgcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttagatttctatcaatgaaagtagacgttaaaaaaaaaaaaagatatcacagtacgtggaaacacgtgacacatattttaaagggaaaatataaacgtgaaatgcgtggaaactggcaagtagactattaatatttatgggcctatagtggttatatcaggctttattgggctctctatacgaattaaaagcctcaaacaaataatagaacttgaattgtaggcttttgtacccaccaaactggccgccggtgaccccctctcacgccgtatctctttttctttttcttgtttttttttttttttttttttttttttttttttgtgtgcgcgtatttgtttcaccatcaaaaaattaattttgttttaagtgttttattttccttcgttttgtttaaagtgtttaaaatcgttagttcaatgttgaaaaatatacaataatagaaacaattgtgacttttgtaatttgaatgaacaaaacatataacaataagtcctataatataaacattttaatttacattttcaactttttctcattttaaatttttattcagttgaaggcttgaagcgttggactactttagagaaactttacaagaacgttcttaacatctttttttctttcctttttgaatatcaaaatcagttaaaaacacttttgatctcacagaaactgatacaaagccgacggaaccgaccagattaggtcaaaaacgtaaaagacgcgcaaaaagaaaagaaaataactcataatagaatgttttagtcagaagaaaaaagtacaatatgaccaacgtaaacaaaaaagatgttgacgacataaagaaaagagctacagagacaaaggcattaaaatatcttttgtcgaaatctgaagatatttccttaagcgcgtttgcttctctgtctcctccattccattctatatcatctctgtctttgctctaagctttcctgtcaaaacaaaaattcaattccccacgtctgtcttatccacaataaaaccgaccttagcttagcttagactcattactcatttcacaaaaacagagagagaaatagagagacatactttacaggtaataattatcttgtttaattgtattatatatctctaactaaatttgggataaaaattgtctattcttgatcattcctctctgtatctctctgcttttgacaccttctcttagctgttttttcatcttttatctctgtttttaaaatcttttggctctttcgaagggtttcgagtccttttgagttctttgggcttcctcccaaatttctccacgagctcgacccctttcgtatcttccttctcatttttttgccaaatttattcgatccgtctttcactacaactttgtatacaaaagttgtaatgacaggaggctttaggaaatgcatggtgctttgttgtgcaagaaaactcccgaaagaaacaacaatgggaaccaccgcatacgacgaagccattacagggctgagcaagcttctcagtgagaagaaaggattggatgatgtagcagccgcaaaaatcaagcagttaacagcagagttgcagcagggcaccaagcaaaatggtgtttccgaaaacgggtttgacccggatgagcgcatcaaatccggattcatccggttcaagactgagaaatatgagaagaatcctgctctgtacggtgaacttgccaagggccagagtcccaagttcttggtatttgcctgctcagactcccgtgtttgcccctcccacatcttggatttcaagccaggggatgccttctcggttcgtaacatcgccaacatggtcccaccttttgataagacaaagttctctgggacaggggcagccattgagtatgctgtattgcatctaaatgtggagaatattgtggtcattggacacagctgctgtggaggaataaaggggctcatgtccatccctgattgtggcaccacttccacagacttcattgaagagtgggtcaagatcgctcagcctgctaggaccaaggtcaaagcagaagttagtagcgcagagttcacggagcagtgcaagaactgcgagaaggaagctgtcaatgtctctctcggaaacttgttgacatacccatttgtgagggaagcagtaatgaagaaaactctggcattgaagggtgcacattatgattttgtcaatggacgtttcgagctgtggaacctcgaatttggcctctcaccttctaccgcagtaaacccaacttttctatacaaagttgtaatggaacaaaagcttatttctgaggaagatcttaacggtgaacaaaagcttatttctgaggaagatcttaacggacttgatggagaacaaaagcttatttctgaggaagatcttaacggagaacaaaagcttatttctgaggaagatcttaacggttctgcttagacaactttgtataataaagttgtattcttctgtgcaatagcaacaatggaagattgggttcggtttcagttgttgccataccgtataaatgtgttcttaaagagagtctttttgtcgaggcttttcttcagttgggatgtatatgttttattaaggtgatgagtagtgatttggtgtgtcttttcaaatgctttgtggagtctgtttttccttataaaaatttattctaaatctggtttgtattttgggggtcttctttgctctttcttcattaacagaatactaattataagcttttcatatacaaaccttgaaaggaattttcatcagttactaattcgatttcagagaaatgaatcattcaaaacacttgattagagaaatgcttcttgaaccgggtcggtttaacgaaatccactggctggaaaaattatgcttttatatatataagaagcacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtgcgtttttatgcttgtagtattgtataatgtttttaagatcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttaaccgcttaatatcgtatgattagtattaaaaatcttctccagaatttcaacgttgtttttgctactcacgcattgtaccttaaatgatcttattcatcatttctaacaaaacaatttatgcattcttcgccagtagaagaacctagtagagtgctatcggcaacaactccgtcttgttcatgcggatgcaaaagaagacgtccatgcccacgtccacgtccatgtccacctccacgtccacactattcaagaaattatacagacccttgaaaaagaagaatgaagaagagaaaacaaggatcaattatgggattggtacaatatagttgagggtattgtctaatgtagtacttttgaatatgcttatagatttagacatattaaagactattttctccttttaaatcaatgaagaaaatacttgagttcaatccttcttttgcctttgcataaccgtctctcatccacaccaacaaaacaaatcccagaaccttcttttgcagaattttaaagacacacaaagcaatgaataagaacacttggtttacaataacgatcgaaactggtttacaataatgaccgaatatggtttgcaaatatagatgaattggaatttaattgattcgatctatatctaaaattaaatttcttgggttccctaaatactatcctcttagggtttagatttctattatcaaaactctcgtttaatttgagcaaattggttaatcggagaggttagggaaaacaacgttttctggtataaagagacgagagaaacggtattgatggagttaaaagtgatgatgttgatgaaatactgagtcaacgttaataaggcaagagccgactgtgagaagcaaggtttcatggttgggaattttgttgcgcaacggagaagatgaagtgaattttgttgcgcaacggatttccgcaagcttttcccgagaaaacaaagatatcatctacattctatttttgtgctgtaacttttctgaattttttgtaaacaattttttgtgatatatatatatatataaacaattttatatcattaagtatggtactctttaatgtttttaacggaacatgaccaaaactgctagtgaaagcattttgtcttaactttacaaaagaagttatcttttttttaacacaaactggttttcttcggtaaataaaaagactaagtttgtaaatttattcttagacaattatttactattattgccgactaatatgaaaatgcaaagaagtcgtatttggcattatccaaaagaagggacaaaacacttatctcttaaaacttaaattttaagccattcgtttaccaacaatgaatcttgtggctgatgtagaaaccgcgttcacttgtcaacatttagaaataatgttggctttcaaagaattaaatagaaacaaccaaaatgtatgaggttgagcgtcttctatatatttattacaagacttgcgatgaccaaaaacgcaacgaagaacgaaacaactttgtatacaaaagttgtaatgtgtgagagcttcaagagagaataccagctctgcgaggagatcggtcgaggccgcttcggcgtcgtctaccgctgctacaacccctcctccaccgaagattccgacactcctttggctgtcaagtccattgataagcgcctcttcctcgacgacgagaccgaccgtgagtgccttgacaaggaacccaaaatcctccaccttctctctcctcaccctaatattctgcagatccataacctctttgattctgatacccatctcctcattgttaccgatctctgccaagaggagaccctttacgaacgcattatctctaacggccccttctctgagcctgacgctgcggctattttctgtcagctcgccgaggccctcgctcactgccaccgcaactacgtcgctcaccgtgatatcaaaccagacaacatactattcgactcaaggaacaggctgaagctctgcgacttcggctcggccgagtggttcggagcaggagacagagagatgcgcggtgtggtaggaacaccctactacgtggcgccggaggtgctttccggaaaagactacaatgagaaggcggatgtgtggagtgctggtgttattctctacatcatgctcggtggagttccacccttctatggtgagactgttgaggagacttttgaggctgttcttaggggaaatcttcgctttccggccaggattttccgaaacgtttctactcaggcaagggatttgttgaggaagatgatgtgcaaggatgtttccagaaggttttctgctgaacaagtcttaaggcatccttgggtaaccagtggaggattggccaacatgaacccaacttttctatacaaagttgtaatggaaggaaagcctattcctaatcctcttcttggacttgattctacttgaacaactttgtataataaagttgtatactttgagtttgagttactctgtgttcgaattttaaagtatatgtggttttctgttttagtttcgtgtctcaactctcaagtgtagaggaatgttataaactactatgcaatgaaggaactaatacttatgatggtattttactaattatgttattattcataattccatgcattagagccaattgtcgcattttttttctttcagaattcttcaaacttgtcaaatcgaaatctcttctttagaagcgactagattagtttttttcttcaaaagaaattctctactgaatttataatttaaagagttcacgagctgcctactaaaatatgaaaaatatttatgaatccagcaatacaaattgtagctttgcaatacaagaaagaacaacttttcatagagatcaaaaacgctagataaaaaaaaaacggggaagactaactagtaagtaccacgagtataacacattttttggatttagtttctatgattgctttcgccacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtctaatacccaatctctcgtcttatccagatgttttatacgcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttactgaaatttagtagagaaaaatatatgtttttttctacatacagaatagtttgaatttttaaaatcggatttgaattttaaaaatagaaatagtgtttgtaagtaaaaaatatattgtactatttaagatgtatagaaataaaatattgttctatactattttcataactgatttgtaaatcaattttaattttagtatagagcaaaatgttttaaatataaagtaatagtgttggtagtggtgatgagatagtagtttatgttacgttaatatagcattataatcaattaaatgtttttgttggaaggatactaaaccctaagtggataatatattgggaacccaaagatttcaatctaaaatttaatattctttaaccatagaaaaatagaataatatatgtttgtcatcactaccaacataacgagtagcacagcacaagatagtctcttggtagaggaaagaagtggtagtagagaacaccgggtacaccatttgggttccacaatcgagggcacaaggagacacgaactcgccacacttaactagaaattgatgtaactccaaaaaaatccaaaattttacctttgtaaatcaaaacccccaattcaatttaatcacaaaccctagacgtcaattccaaaaattaaatgtattgattccgtcgccaatacatctccattgaacgttttcagaatccgaagctttacaaaaaggagatagtaatttttgggacccaaaaagctgttggaatgttaacagctgatgagaaagtgttttttggaaagagagaagaagaagaagaaaaagagcctgtatctcaggcaaagggtagcattgtcattattacagaaaatacaaataatatcagtatctttttgtgggatggttagttacttaattataatttttttgtagattaaaaactcaaatttctcaaaattatactctcctaagtagaaaaattttacaagtttgatttcttgaaaattgatattataatttatttttctgattagggtgggaagattctttataatttttttggtttacctgaaaatgaaagaaaagattgtaagaaagatacaacaagtgtagactggatcttttaaagtccaaaccaaaagccaaaaattaggtaacctaaatatgtaagactttattttttggtttttcttattaaaacaacatttcgataattcattatgatattttttacgctatgatcctcagccttaaactttcattcgtatagaaggataatatcataatagtacaactcttttaattgccaccaatcaactttattgtctgctttcaaaaattttattttttataaaatattattcattttagctataactcaatttggaacttttattcgtcccaaataaaatatctttccaagagagatggaaaaatagcttcatatagagatattttcaacaacttgtccctctctaaactcatccaccttccaaaacagagaaggggaaaatacaactttgtatacaaaagttgtaatgtcgactgtgaagctagataggcttacgtcgattgatgcccaattgaggctgcttgcacctaagaaggtctctgaggatgataaacttattgagtatgatgctttgctgctcgatcgcttccttgatattcttcaaaacttacatggggaagacatcaaagaaacggttcaagaattgtatgaacaatctgctgaatatgaaaggacacatgaccccaagaaattggaggagctgggaagcatggtgaccagtttggatgctggagattccattgtggttgccaaatcattttctcacatgcttaacctggctaaccttgctgaagaagtccagatttcccgtcgcaagagggtcaaaaaagtgaagaaaggagattttatggatgagaatactgcgatgactgagtcagatatggaagaaacactgcggaggcttattgtggatttgaagaaatccccacaagaaatttttgaaactttgaaaaaccagacagttgacttagttttcacagctcatcctacacaatctgttcgtagatccttgcttcaaaaacatggaaggataagggattgtttggcccaattgtatgccaaagacattactcccgatgataagcaggagcttgatgaggctctgcaaagagagatacaagctgcatttcgtactgatgaaatcaggaggactcagccaactccacaggatgagatgagagctgggatgagctacttccatgagacaatttggaatggtgttccaaaatttttgcgacgtcttgacacggcattgaagaacataggaataactgagcgtgttccctataatgcccctcttattcagttctcatcttggatgggtggtgatcgagatggaaatccgagagtaacacctgaagttactagggatgtatgtttattggctagaatgatggctgctaatatgtatttctcccagatagacgagctcatgtttgagctctcaatgtggagatgcaccgatgaacttcgtgaacgagcagaggaacttcacaaatattcaaagagagactccaaacactacattgagttttggaaacaaattccttccagtgagccttatcgtgttattcttgctgacgtgagggataagctctactatacacgtgaacgttctcgtcagttgttggcaagtgaggtctctgaaatccccgtcgaagcaaccttcaccgaaattgatcagtttctggagcctcttgagctttgctacagatctctctgtgcttgtggtgataggccagttgcggatggaagtcttcttgatttcatgcgacaagtagctacctttgggctttgtcttgtaaagcttgatattaggcaagaatcagagaggcatactgatgtgatggatgccattactacgcacctgggcattgggtcctaccgagactggacagaagagaagaggcaggattggctcttatctgagcttaggggcaagcgccctttgtttggccctgatcttcccagaactgatgaaattgctgatgttttggacacaataaatgtaatcgcagaactcccatctgatagtttcggcgcttatgttatctcgatggctactgccccttctgatgtgcttgctgttgagcttctgcaacgtgaatgtaaagttaaaaagcctttgagggttgttccattgtttgagaaacttgctgacctggaggctgctcctgcttctatgacccgcctattctccgtagattggtataaaaataggattgatgggaagcaagaagtcatgatcggatactctgattctggtaaggatgctggtcgtctctcagccgcttggcaaatgtacaaggttcaggaagagctgcttaaggtttctaagaaatttggggtgaagctcacaatgtttcatggacgaggaggaacggtgggaagaggagggggtcctactcatcttgctattttggcacagccagctgaaactattggtggatcacttcgtgttacaattcaaggtgaagtgattgaacaatcctttggagagcagcacttgtgttttagaacactccagcgttatacagctgctacacttgaacatgggatgaatccaccaaaatctcctaagccagaatggcgtgctctcttggaccagatggctgttgttgccacagaggaataccgctccatagtttttaaggagcctcgatttgtcgagtacttccgtctcgcaacgccagaaacggagtatgggcgcatgaacattgggagcaggccatcaaagagaaagccaagtggtggaattgaatctctccgtgcaatcccttggatctttgcatggactcaaactaggttccatctgcctgtgtggctgggcgttggcggagcacttaaacatgtccttgagaaagatataaggaaccataacatgcttagggacatgtacaacaatttccctttcttcagggtgaccattgatttgcttgaaatggtgttcgctaagggagaccctgaaattgccgctttatatgacaaactactggtgtcagaggagctgcagtcctttggggagcgtttgagggcaaattatgaagacactaaacgccgtctcctcgaggtcgctgggcataaagacctgctagagggagatccttacttgaaacagaggctccgccttcgtgatccctacatcacaaccctcaatgtctgccaagcgtataccctgaagcggattcgtgatcccgacttcaaggtaacagagaggccacacttatccaaggaaatcatggacgcacacaaggcagctgctgagctggtgaagctaaaccccactagtgagtatgctcctggacttgaagacacacttatcttaaccatgaagggtgttgctgctggtctgcagaacactggtaacccaacttttctatacaaagttgtaatgtctcatcatcatcatcatcatgcttagacaactttgtataataaagttgtagattcatagatcatatatatgtacatcatatccctctttagagcaggtactcgtgttcacctgcaaatgtaacaaagaacattatactatacaacaaatatacacattgaattatacctgtataaccaacataggtcaagattacatcatacgtgggctaggcccattttatattggcccaataagtgagtgactaaatcctttcgttcccaaatatatctccaccgatcaagagattcatcttccacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtgaattcccttatgtgagtgtaaaaggcaggcgagtttgtccccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttaaaagaagagagaggaaggagaagagaagaaaaagaagagagacacaacggagcgccaagaggctgatgaacacgtcaccgtacacgtgtcatgatcttgaagggtttgcaaagggaacgcatatgctgagctggcaaccctagatctgcgctggacattttaaatatctgacttaaataatgattggtacacgtagtcataatcgccaccgttcatcttgagatctctacgtagacttgacgtgctgctgattttattccttttaaataatgaaaatacagaattaaactataatgtataattcatttgagatccacagatgacgaaacgtggactaccaaatcaagcatatttgtttttaccatttaatcgacggctaatattgatttcatctacggtaaaatatatctttttttaaccagaaaaaggttagagtggtccccactgtaggatctactgacttgtgtcggccgttagtggttttataaagctgacgtgtcccactgaataaggaataccgttgtggtccctacggacaacgtgggattcgacgccagctcattttttaattttttcttgaaatcttttttaaaattttagacgatgactcaatcttcgccacgtaggatccacccaataaaaaagggttaacaaaatcttatctttaatgctaaattagttgagattaatccatgttgtttaaatccgaaatgatgcatataatcttgtttcttataatcattaagatttagactgaagatctaattccaatttaagagagtcactaaaaaaagaatgaattcaatttcagacaaatccgacaaggtcaaggtgacgtgttcttgatgccaattctagtgggagccacttgacgcgtgcagttagactcccggtccaagacataaatttacgttaataccctcctttattgggttattattgggccgtagttgaattattagacccaacctttttatcctgttcttgattggcacatactttgcaaaaagttaacaaaataacttttattgcaaggcattacaagagaaatgtcaaatttggttgttgcatacatgacatcttattcatatccaatccataaattgatgtgttgttattcaaactggtcttttgatgtattgttagacatatctcatatatattgaacccttggaatcaatataatagattgggctttatttatcttttattgggcttaaagggaattgttggactaaaaaaaccattaaggctataacacactaattacacgtacaatgagagtgagagtcacggacgggatgattacaagaatcatatagcaccaaatatctcatcctcactctcacatacaaacacacattttgttcacacagagatagacacaactttgtatacaaaagttgtaatggccgttgaacctcttcgcgttcttgtcaccggcgccgccgggcaaattgggtatgctctcgttcccatgattgctaggggaataatgctgggtgctaatcagcctgtgatcttgcacatgctcgatattcctccagcagccgaggcattgaacggagtgaaaatggagctggtggatgctgcctttccacttcttaaaggcgttgttgctacaaccgatgctgctgaagcctgcaaaggtgtaaatgttgctgtcatggttggtggcttcccaaggaaagaaggcatggagaggaaggatgtgatgtcaaagaatgtttccatctacaaggctcaagcttctgctcttgagcaacatgctgctcccaattgcaaggttttggttgttgccaaccctgccaacaccaatgctttgatcctaaaggaatttgccccatcaatcccggagaagaacatttcttgtttgacaaggcttgaccacaacagagctctaggtcagatctcagagagattgaatgttcaagtctctgatgttaagaatgtgattatttggggaaaccactcctcaactcaataccctgatgtcaaccacgctaccgtgaaaacacagggtgttgataagcctgttcgtgagcttgttgctgatgatgcatggttgaatggagagttcataacaactgtgcaacagcgtggagctgccatcatcaaggcaaggaagctctccagtgcattgtcagctgctagttctgcttgtgatcacatccatgattgggtgcttggaaccccagagggaacatgggtatctatgggtgtgtattctgatggctcgtacaatgtgccagctggaatcatttactccttcccagtaacttgtaaaaatggagaatggacaatcgtccaagggctgccaattgacgatgactcaaggaagaaaatggatgcaactgctgcagagcttgtcgaggagaagacattggcctactcatgcctgactaacccaacttttctatacaaagttgtaatggctggatctactggagcttcttggtctcatcctcaatttgaaaagggaggaggttctggaggtggatctggtggaggatcatggtctcatccacagttcgaaaagggagctggatctaggcctatttgaacaactttgtataataaagttgtactttgtataagatcattagttgttaattttttaaatatgaatttctaaactatccaccaactaagcatgttgtgacaagcaaaagtatatagataattagatattatatgtatatgtttaaaattgcgtaatatgctttacaggtcgattgttctcctaatcatttgattcttcttaatttattggattacgaaatgacatttctttgtcacctttttcgtgcatatcagatttgtttaaagtttacgtgacgaatgacgattgatcttttatcttgttgtgccgccgtattttgtatggacattacttgtaatactatatatatcagctatgcgttaactatactcatcaaataccacatatgatttattatatcaaagtacttattaataaataattaaattaaccttatattcaattgcacttgggtgagaaagccgttagaaaaaactcccgctatagaagaaatgtggtagatttgaaccgaaattaaatattttcacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggttgcttgcaaaagcagtaattggaaagcactctcaaagaatcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttactctttctaatttcaggttataatttattaattttggcggagtaaaagtagatgaccgttacaagtctgatttattagactgtgaaattggaccgttgttatgtgggccatggcttttattaaaaaaagaagagaaggtatattatttaaattggagataatgggccgttttaaacccaattattattggtccactaaagtttttatatcctctaacttcgacgagcttgatatagttttggaccttttggtgtgaacggtcacattcaactaaattaaaaagtccaacaaacaaaatctggtcatgaaaagcttggtgtgatgtttctaataagtaaatttactgaggttaattggttggtttaacttaaatgtaatccaaactcctctccctttagagattttcagttgggaatgaaaacctttaaagcttgcaccctaaaatgacattaatggttatagatatagtttgttttcatgtttcttttttttttatattttcctttagttttttctagggttgggactaaataatcggactcggatccgagatccgatttgaaaagctggatacccaattgggatggatccgcttccggatcctgaatttttagattcagatgaatatttttttttaaactaaagaaagcatatcagcatcacatttttgtggtgatactgcttcaagaatctgtcacatatctgtccaaaagaaaagaatttgtcacatattgtataattttaatatatttattgttttagtttgaaaacaaacgtggaaaaaaacatcttacaggtgtcaggtgtgccgcgtcgtcccactcaaagcctatatcatcaattttctggctgttctaatctactcaatttatttttttattgttaatttactgaagatcggcgacaactttgtatacaaaagttgtaatggcggggaaattcggatcactgaggcagagtttcattgaaagaagcaaagagaggttgctatctcgaagagggtattcggagctagggttacctggctccgatggtgatgttgaagatgagggcaatagcgatgtcaaatgcggttgtttccgatcaatttgcggcgggagaagtcgaaattccgatagcggaaatcgatctaagggcggatgttaccggtggatttgtgatcggatattagggttctgtaatgggtttaaggaagttgcaggtaaattttatgagatgggtcgatctgatcctcgaaaggtgttctttgcagcgaagatgggtgggagcttagctttggtttcaatgctcatcttcttgaggggacctttatcggatattcgtcagtatgctatttgggctattttaactgtcattgtctgtttcgagtacagcgtaggagcatgtcttagtaaaggccttaaccgtggtctgggaacggtaactgctggaagtattgctttcgggctagcagaattagcagttcggtctggtgaatacaaagaaccgctcattattatgtatatgttcttcgcaggttctattgcgacctacattaaattatacccaacaatgaaagaatacgaatatgggtttcgggtattccttatgacatttgccatagtaatggtgactggaaataaaacaacaaattttttccaaactgcttttttccggttgttgcttatttcaattggtgctgtcatagcttcagtggttaacatatgtgtttaccctatttggtctggcaccgatcttcataaggtggtggtgaaaaatttcaagggtgttgctacttctttggaaggctgtttaaatggatacttgcagtgtgtagcgtatgataaaatcccttcaaagattcttacgtaccaagcttatgatgaccctacatatggtggctatagaacagctgtccagtcagcaagtcaagaagaaactctgttgagctttgcgaaatgggagcctcctcatggcccttatagatcatgcaattatccttgggaatcctatgttaaagttagtggggcactgagacattgtgcttttatggttatggcaatgcatggatgcattcttgcagaaatacaggcaccaccagagaagagacaggtttttgccgatgaacttcgcagggttggcatggccggtgctaaagtcatacgtgaacttgggaacaaagttgagaaaatggagaaactaagccccggtgatatacttgcagaagtacatacggcagcagaggagctgcaaatgagaatcgatgagaagtcttatctcctggtcaatttcgagaaatgggaagaaggcaaacgaccaaaggaatttgatgaccctgagcgtgtttctcaaatgaagagttatggaagtggtcagcttgttataaactccctaagtgaagcagtgctaagtattgaacccgagcagatgcaatcatacattgataatatgagttcaagggtttcaatgattggtgctggcccttcattgcaaggtatgttttccactgatagtatggcgactagaactcagtggccttcacgtctttcactcctaccagacctgagcatcaatgaaaaggaagcgaaaacatatgagagcgcaagctccttgtcactagcaacttttgcttcacttctagtagaatttgtggcaagacttggatatttggtggaggcctttgaggaactcagtgagaaagcagctttcaaggagcaaagtgagctagaagacgaaaaggcgagtaatgggctctggcataagttgatggtgtcccttcagttcagaaataacccaacttttctatacaaagttgtaatggcttctatgactggtggacagcaaatgggtgcttagacaactttgtataataaagttgtaaggttgaagaataagaattaaaaaattgtatttaaactataaaatatgcatacataataaattttgatcgtttttaactaataaaacatatggtgtatcatttcaatctcacatgaattaaatcttggtgtgtatagactatacagtatagtagtttgttttgtaaaccgaaatcagaacactggctgctggccggtttacttaatttatgaatctatatatacatttttgcagtcattttgtgaaataaatcctgtagttgggacttatttacaatggctgccactggattttaatgtttgtttttgataattagaaaaaaaatcttcgaattaaatattttacatttaacaatcttccctaaatctctccacattaactacacggttagttactaaaattaaacttccaaaatatttaatatcatttaattactacaaaattatcatttttgatattgtttttctccatgactataacaattcgactataatcatcaacacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtagataagttgatttagccataaaatattgtttccgtgacccccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttattaataaattagtaatgaacacctagactcgtatcttctaatctcaatgtttaatgaatggtaaaaataattatttaattttccgtggtcaacaatgcataatctttttatttattttgtcttcttacctttcaaaaatttctcaacttgtcaacagaaaaaataaaaatcccaataacaaaggtgacaaccgaaacagaagcacatgaccacaatgctaaagatggataaaaaaaatagagcaaaaagaaagacaaaaatttcagtagtcaagagtataattaagcacgtataatttgcaaaatttttattttatttttatgaaccgtttggtgtatatatataatccttgctttccagttttgatgatctttttgtgctactttgtatgcggttaaagattgttgtaataggcaaagaaatcttaagtaatgcctcagctgttaaacgttgtgatctcctctgttcaaaatatttcaagttgatcttacttatggtaatgctctactcgtgattgtgagtttgaactagtcactgttaaggttttctttataattgattgtcaagctaatgaataagtttgtgaatgaggttttagaaagatgcatgattggaagttgtgtttagtaaatgcttctcattacaactagaatttactatagaatcatagaacggccataaccaaacttcatgagtccggtgatattattggaatagaattcacataattttcatacttttgttacttagactgtctacataatgccacataatgaaaatttgaattagaaaacttgaatactaaatctacagatatttcaagtgacttctaatgtatgacaataagacattaagaccccttccatatcatgaccatttcaaactcgtgtcaatatgtaacccatttatcgtgggccataaacccaaaataataaatcatgtatataaacgggctattgggccataaactagtgataataagctttggggcgacgatctctggatacgtcacccctcgcgatacaattacaaccgatcaaggtcagcgaatactccgacatccttttcttgcggcccacatcggtctttagtgaatcacatgttttttctattgtcgtttcttgcgcatcaagttctgctgaggtttcttgttattttatttttgaaatttttcaacacctttaacttatctcgattttgtttaccacttaaaaaacgcccaaccaatggcatacactgaaaatgttttctaaacatttaatatttctgtggctaccaaaaagaaatcaagagttattttccatttattctgggtgaaagagaaacagagtgccacctgtcatttcctaatctggcacgtaggtttttctcatacgtattacagtgaataatacagtataccaaaggcggctcgtagcagagtttgttcgattctcttaaccacattaggtttggagtattatttgcttctctcgattgaagaagagtacctaaagaatcacaactttgtatacaaaagttgtaatgaatcataatcacgatcccaaaactccccttctcccaacccatcatgatgatgatcatcaagggcggccaacacctgagcgttccacctcagttatcatgtcccttgccacacccaacacggccttcgtcctcctaggacccctcttgtgtacccttgtaatgttgtgtgtcaagttcgatgggaccgagtcgagccggaacatgctggctatcctggtctggatcttcacgtggtggctcaccgaggctgttccgatgcctatcacctccatgtcgccgttgtttctatttccggtgtttggtatcgcctcggccgacgctgttgctaagtcgtacatggacgatgtcatctctcttgtgcttggtagcttcattcttgctcttgctgttgagcactacaatattcacaagaggctggccttgaatataacattgttattctgtggggacccagtgaacccaccgttgctcctcctggggatctgcgccaccacagctttcgtcagcatgtggatgcacaacgtggcagccaccgtcatgatgatgccagtggccaccggaatcctccagagatttccatccacaagagaaggcggccgaaacgacgccgttgacaagttcagtagggcagttgtgcttggggtgatatactctgccacaattggtggtatcagcactctgactgggacaggtgtcaacctcatattggctggcatgtggaagagctatttccctcaagcggaccccatcagcttcaacacgtggctcttttatgggttcccattggctgtctttatcttcttctcgttgtgggccatactttgttgtttgtattgcaaacgtgggtcgggccgggtccttcaggagtatttggataaggatcaccttcaaagagagctcgacttgttaggtccaatgtcctttgcagaaaaaatggtattatccgtctttttggggcttattatgctatggatgacaaggaatctaaccgatggtatccctggatggggagctctatttaaagggagggccggtgatggcactgctagtgttatgatggcaactttgttattcataatacccaacaagaggagaaagggagaaaagctaatggactggactaagtgcaagaaactaccttggaacgttgttcttctacttggggccggctttgccatcgcagatggggtgcggtcaagcggcctagcggacgtgctttcccgcgccttggacttcctagagacggctccattttgggcaattgcacccatggtgtgtctcataggtgggatcatgaccgagttcacctccaacaatgccaccacgacattgttggttcctctgttgatccaaattgcacagacgatgcacgtgcatccgcttcttcttatggtccctggagccgttggggcccaattcgccttcttgcttccgactggaactccttccaatatagttgggttcaccactggtcatattgacatcaaggatatgattaaaactggtctccctctaaagattgctgggacagttgtactctcatttttaatgcctacccttggagcctacgtttttgggacaaacaacaaaccgctgatgtacccacaaagttggcgtagtttgtattcaaattcgggatatacaaacccaacttttctatacaaagttgtaatggactacaaagaccatgacggtgattataaagatcatgacatcgattacaaggatgacgatgacaagtgaacaactttgtataataaagttgtatccatatcccctccacttcgccacgtgcttcttcttctctatgtctctatcttgttcactttatgacctctaatcagttgaaatcatatgttgtttacttggaacaattcaatgaaattcagcattttagaaagacagggtattgactttgaaattgaatcatctggtttgactgatagtcaatttaaatggtattaacttttgactaagcacagttagttttcaacatttttaaaattgaacaattaaattgaaaaaacctataagctatggttaaagattgattagtaaaaaatgtttgcttttgcataagagtagaaaaagttttatgggtttaatattttttgtatcaaacatttgaaatatttcttgtatatctgtaaaattattttaaaatatctattataagatttatatgagttttccacttccacatgattcatgtgatacagaaagtgcatctcaaaacttctagagtttccctaccaaaaaaaaaaaaccacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggttctgagtcacggcttcattggcattccgtacaacgaacgtcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttaagcttatagcgtagagatgattcactgatgttagtttcattcctatggaataacaaaatgcttttgatggtatcttcatgaacatgtacgttcacaactatctttgtagctctataactatttggtaactccggtttaagcaaagttctacactttaataatatcgacttcgttaatatatacaaatgaaaatagtcttatagatgcgagagcaaatgtttgagggtaggttaaaggaatcttgagatatggataaacgacactaagttgtgtcgtagcgagacagatccaaactacgacaagtagtaaacggagataataatatccaaaccataagaatccatgaaagcaagtagacaactgcgactttgcctcaccagtcaccatactaataattggagaggtggatctcttaggaatatttacttttataaaagatcagaggctagtcagaactcagggactaaattttattttcagtagtgacatctttaaaagacaacagagatttataaaactccacgtgtacagaagtgaaacagtctgacatgatgcctgatgctaactaactatgtaagataagacatatcttacatagttagttaccatgtaatagtaagtgataacccaaaaatgcaaaaaaaaacatccaactagaacatgtgatatgtcagtatgtgtatgagatcatgtgcacaataatattatcggtatttgtatgtctagttgtctacactctacagctcttactggaaatagattttgaggaacaagaaatagttgaatgagtcattgctatcttctagattttttttttttctgtcataatatcttctagaattttattacttgggaaagcgatatatgatatattctttttccaaaatttactaattaaaaaaaaaaaaaaaaactaagcactctgtatttattgccatattgaaaatgctctttccaccaatattccttatttgcctcaaatcattactttcggattctactgtcttgaactgtgttcatgtgtgtattccctcatcaatcaccttcaattcatattttcctatttccaaaaataaaaagatacagtatctatgtatttaattatatatcatatcaattatatcataataatcataagatcctttttatcgaaataaaaaaggaaacaaatccaatcatagcaagctttttcttttatttaataaacaaaaataaaaagcttcccgaaatggttaaaatccagaaccactaaagtcaaccaaatttgtcaaattcatccacgtcatcagttccatctataaaacgctcacgccattcgtcaagtcccaaaacaagagtccaccacaactttgtatacaaaagttgtaatgggtggtagcaatgcattgaatgagatgaccaatggatctgatggtattactgggggtgttgctgatgtctatggtgaagagtttgccacccaggatcagcttgtcaccccttggagcttctctgttgcttgtggtcattcattgttgagagatccccagcacaacaaagggcttgcttttacagagaaagagagagatgcccacttcttgcgcggtctgttaccccctgtagttctgtcacaagagctccaggagaagaagttcttgacgactcttcgtcaatatcaagttcccttgcagaaatacatggccatgatggatcttcaggagaggaatgagaaactgttctacaaacttcttgttgaccatgtcgaagaactgcttcctcttgtttatacgccaactgttggtgagggatgccaaaagtatggaagtatttttagacgtccccaggggctattcatcagtttgaaggataagggaagaatccttgagcttttgagaaactggcctgaaaagaaaattcaagttattgtagttactgatggtgaacgcatactggggctaggagaccttggctgtcagggaatgggaatacctgttggaaaactttccttgtattcagcccttggtggagtctgcccatcagcatgcttgcctataacccttgatgttggcaccaacaatcagaagttgttagatgatgaattttacattggattgaagcagaagcgggctactggagaggaatatgctgagtttgtccaagaattcatgtctgcagttaagcaaaactatggggagaagatccttgtacagtttgaagattttgccaaccataacgcatttgagttgctggagaaataccgcaccactcacctcgtcttcaatgatgacattcagggtactgcttctgttgttcttgcaggacttattgcttctttaaaactactagggggaaccttggctgaccataaatttttgttcctcggtgctggagaagctggaacgggtattgcagagcttatagcccttgagatgtcaaagaagacaaaggctccagtagagcagatgaggaaaaagatttggcttgtcgactccaagggacttgttgttagctctaggaaggagacacttcagcagttcaaactaccttgggctcacgaacatgaacccattacaactcttatagatgctgtccaggcaatcaagcccacagtgttgattggtacttctggaaaagggaaacaatttaccaaggaggtcgttgaagccatggcaaatatcaatgcgaaacctctcattcttgctctatcaaatcctacttcacagtcagaatgtactgccgaagaagcctacacatggagtcagggacatgcaatatttgccagtggaagcccatttgaccctgttgaatatgaaggaagaacttttgtccctggccaggcaaataatgcttacattttccctgggtttggtttgggtctgatcatgtgtggtgcaatccgtgtccatgatgacatgctattggctgcctctgaggcactggcttcacaagttacaggagaacatttcataaagggacttatctacccaccattcaaggacatcagaaagatatcagctcacattgctgccggagtagctgcaaaagcttatgaacttggtttggctagtcggcttcctcaaccagccgatcttgttaagtttgccgagagctgcatgtacaaccctacttaccggagtttccgtaacccaacttttctatacaaagttgtaatggaacaaaagcttatttctgaggaagatcttaacggtgaacaaaagcttatttctgaggaagatcttaacggacttgatggagaacaaaagcttatttctgaggaagatcttaacggagaacaaaagcttatttctgaggaagatcttaacggttctgcttagacaactttgtataataaagttgtatttgttatgtaacttattcttctaataaaaaactccgctagttcatatcttgttaagtatttggttagcctaagaaattatatagcttgaggtttcacattttcaatattttttaaaaataatttgggtcaatattgatgttggaaatgaaatcaacggttgaattattgtcgtgtgctgcttgcaccatggtccatgctagatggaccgaccactatttttccaaacagtgcctatcctatcaagtagatattttctgaatacgtagataattgtagaatacaagaaaagaaatatcctctgtggaataaatgaataatatacttttgtcagaaacgttacaagttaaaattccacgactgattgccacgtgtaagcttatctcaaaagggccctacagtaccatgatgacgtcatctcttacaccactctctgaaaaattcctccgccttataaaaaaactcgattatcgtcttcacttagtcacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtcctcagagagcctatagcggtaaaacaacaccatgcatcccccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttagaacagataagtgaagtttctctgcgatttttctaatgttgaatccatcaaactaataagtggtccctaaacctacatagtcgatggtaaaatgtcaataatgtttgaaagtttagataataccctgaaaatgacgagtcccttcgtttacttgtaataatgggtgagaactacgacacagttccatagcaactttcatatttcgagaattaaattatattccgcagcaaatgctatgtccttgtaaagctctgtttttagtctatgaccatacttgtaaaacatgttgtttttttttgtgtgaattaacagttcattcaaaataaaaataaataaataaataatcgaaaatgtaactctgtggttattgtagcttgaaaaaacgaataatcaagtgtgttgttcattctcttcgttcgttgcacactggtatagcttgttgctgtcatctactgctgactccagcgataatgaaacgatcagaaccacgaaatttactagaactcagcttatcggaacttggaaggggaccagatgagtattaggctaattcgtcgtgttgtatttttcaactaatgcgtcagtgtcgtttttattttcaactaatgcgtcagtgtcattagtttcggaaataaacgatatttgttttgtttttgtattgggtcctatatcgagcgagattggcatgtgagttgggttggctagggaaaatggtaaaatctccacattttgttttgaaaatgtgaaaaatacatttttccctacagcggggatatgaatcagtactatttataatgcaagatatgtaaatttaaaagacatcataagaaaaacaaaactacagaatttcgcttaagctttcaaagatatcgatttgaatataatggtgcatttgcggggttcagtttccacggaaccggtaaatttaaaagccaaataccttaaaagagttgtgaaacagggttacaaatatacatagtggattcgtatgaaaaagaagggaggaatgagtcctacacgtagtcacatcacatatgaaagagattgcttttgaaaatcgaatcctcttctaatattaaatctttcaagactggaggttttaaacaagaaaatcaaactcgacaactttgtatacaaaagttgtaatggcgtcagctttcaaggggatcttgatcagatctccacctgatgtctgtgcagagacagtagcaaaagtgagccaatgcaatcgagctcaacttgttaagaattcgtccactggttttaaaaatatcttcaaattatcagaggccaggaaatttcacgctccagttgcaagtcatttgaggtcacaagccgtcatggccccagcctcagacccaacatcaactgcaataaagagagtattcacctttggtaaaggaaggagtgaaggcaacaagggtatgaagtccttgttgggaggtaaaggagcaaaccttgcagagatggccagcataggcttatccgtcccacctggattgactatttctacagaagcatgccaagagtaccaggagcatggaaaacagctctctgctggtttgtgggaggagatattggagggattgagagtcatagagaaggatatggggtcttaccttggagacccttctaagcctcttctgctttcagttcgttctggtgctgcgatttccatgccagggatgatggacactgtcctcaatctaggacttaatgacgatgtggttgcaggactggcagcaaaaagtggagaacgctttgcttacgactcatacagacgtttcctggacatgtttggtaatgtagtcatgggtatttctcactcatcatttgaagagaagttagaaaagttgaagcaggcaaaaggtgttaaacttgatacggagctaactgcatctgatctaaaagaggtagtagaacagtacaagaacgtctatcttgaagtaaaaggagaaaagtttcctgctgatccagaaagacagcttcagcttgctattcaagcagtatttgattcatgggatagtccaagggccatcaagtatcggaacattaaccagataacaggactgaaagggactgcagttaatatccagtgtatggtgtttggtaacatgggaaatacttcagggactggtgttcttttcactcgaaacccaagcactggtgaaaagaagctctatggggaattcctgattaatgctcagggagaagatgtagttgccggcattagaacgccagaagacttggacaccatgaggagctgcatgcctgaagcttacaaggagcttgtggagaactgtgaaattctggaacgacattacaaggatatgatggatattgaattcactgttcaagaaaataggctatggatgttgcaatgccgatctggtaaacgaactggtaaaggtgctgtgaagatagctgtagacttggtgaaagaaggaatagtcgacacttacactgctattaagatggtggaaccacagcatcttgatcaacttcttcacccacagtttgaagacccatctgcttataaagacagagtgattgctactggcctgccggcatctcctggagctgctgttgggcagattattttcagtgctgatgaagctgaatcatggcaagcacaaggaaagagtgtcattctggtgaggaatgaaactagcccagaggatgttgggggtatgcatgcagcaattggaatcttaactgctaggggtggcatgacatctcatgcagctgttgtagcccgtgggtggggaaaatgttgtgtttcagggtgctctgaaatccgagtgaatgatacagacaaggttcttttggttggagacaaagtaatatcagaaggtgattggctttcacttaatggatctactggtgaagttatcttagggaaagtaccactttcacctcctgctctcagtggggatctagaaaccttcatgtcttgggcggatgatatacgtgtccttaaggtcatggcaaatgctgacacaccagaggatgctttggcagcaagaaacaatggtgctgaaggaattggactttgcaggacagagcacatgttttttgcttcagatgataggattaagacagtgaggaagatgataatggcagtaacatccgaacagagaaaagtggctctggaccagctattgccttatcaaagatccgacttcgaagggatttttcgggcaatggatggtcttccagtgacaattagattgttggaccctccactacatgagttccttcctgaaggtgatgtagaacaaattgtcagtgaacttaccttggagactggcatggctgaagatgaaatcttttccaggattgaaaagttgtcagaggtcaatcctatgttgggtttcagaggctgcaggttggggatatcatacccagaactaactgaaatgcaagcacgggcaatcttccaagctgctgtttcaatgagcaaccagggtgttaaagtttttcctgagataatggttccccttgtaggaacgcctcaggaattaggacatcaagtgagcttgatacggaatgttgcagaaaaggtattctctgagacgggttcctccttgagttacaaggtgggaacaatgattgagatccctagggcggctctggttgcagatgagattgcaatggaagcagaattcttctcttttgggacgaatgatctcacgcaaatgacctttgggtatagcagagatgatgttggcaagttcctccctgtatacttgtccaagggcatacttcagagtgatccatttgaggttttggaccagaaaggtgtgggccaactcatcaaactagcaacggagaagggccgtagtgcaaggcctagcttaaaggttggcatatgtggggagcatggaggagaaccgtcatctgttgcatttttcgcggaagcaggattggactacgtttcatgttcccctttcagggttccaattgcaaggctggcagcagctcaagtcgttaacccaacttttctatacaaagttgtaatgtcttggaaagatgcttctggatggtcttgaacaactttgtataataaagttgtaaattgggctaatgattaacatgaatatttttcataagtctaaaaatatgttattctctctctttcaaaatacattgaatttggtattagttacttttatttatttaagtttggtgttaactttagtactttaagccagaattttctttgaaaatctaaacgaccttattttgagaattctttaagaaagtaagtcttgaaacaattcgaacaagcttaagcttagtttcagcttcttattcttccttagtaatttctcttgatcccgtggcaagtagatttattcctttattgtacgtattgatgatgcctcgatcacttagatgagtccttgttaaagggaaccaaacttcaaatccgactatcattttcttattttctggacaaaaagtctaaactcatatattacagatgtttaaaattttgaatagttttgtctttaacgaggagctacactagtaatggaagcttcgtcgattgaaaagaggtcagatgtatccacacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtcgcagtcgcttcctgtaaatagagcattaaattccatagtcccctgcaggcacgtaataagtgtgcgttgaatttattcgcaaaaacattgcatattttcggcaaagtaaaattttgttgcataccttatcaaaaaataagtgctgcatactttttagagaaaccaaataattttttattgcatacccgtttttaataaaatacattgcataccctcttttaataaaaaatattgcatactttgacgaaacaaattttcgttgcatacccaataaaagattattatattgcatacccgtttttaataaaatacattgcataccctcttttaataaaaaatattgcatacgttgacgaaacaaattttcgttgcatacccaataaaagattattatattgcataccttttcttgccataccatttagccgatcaattgtgctcggcatctagagttatcaacaagtttgtacaaaaaagcaggcttattttaaatatctgtattttgcctccttttcattctattttgtttgatacaaacgattgtggtttgtaatgttaaaattaggaatgttattgaatgatatgtatatttcataaaaataataataataaaagtaggatgaatagtaaaattccaaggcatttcataatttacccattacatggtcaaaatttatcaatattttaaaataataataatcatccaatcaagattttgggaatagaatatcttaagaacttagtataattacatatatatatatatattcccttttaaatgtatcaaaaacaaactaagaacatacaaggaatttgatgtagtactatacaatttacatgcaaacagatgtagtactatttgatgacaaaaaaaaaaaaaaagatgtagtactattttatcttttcatcggaataattcggtcatgaagctattaattggttttaatgagaatttattataacagttgttgccacactgtcgaaatactaacgcctaacggctagttaaataattaacacgcggtgagaagtgagtgagttacacgaaccactaagaatctaatataggaagataagataagcatttcacacgtgtggtgtggacaatttaacagtgttaacacgcgcatggcatgtgatctagaaattagaacattaattttagcgttttgactttgacctttgaatcactaggcgtaggtatttacacgtgtaacaatataatttttttcaatatgtgatgatcatgggccaacgtttgtgggtaaaggtgtggtgttcgatcatgatccacttaaatttactgaattttagaattataacagcagaaggatataagtaatataccaaacttaactataatctacctctccttgtctatgtatactaaatgtctaacatgtaacacaaagctgtacaaaatttttaactctcaaattttttgaaataatgcaaagctgtaaaaatagctgtacgagaaaactgtacaataaaactgaaaataaaaaaatttgtaacgtttttgataaaagttttgtaaatgtataaccatcaaaactgtacaacttccagctttgataatgaattaccattcaaagctagagtttcgaattttttcattgtatacaaccatttgaacacaactcttttcaattatgccatacatacatttagttaataaattttaccgattaactagtactgacaaaagaaacaaagagtaattatatttttttgataaattgttttattagaaaaatacttaaaattgataaaaataaataaacccaattgatatatttgatattacaataccagatattgaaacaaataagacatgttttgtctatatacttccaactagaagatatttatttatccatatcctagatattttaatgtgtgaatctaatacattctcttatatacgaccaaatagtaaaacaatatgcctctcctgcaatttttcttcatccaatatttctacaactttgtatacaaaagttgtaatgttagcttgtgctagcctcggcctcccaaaaacccaaccgccaccgccactagtttcaccggcacctgaaccaagccgtccggccccagccccatccgtttctctctcctctgactcagcaacctcacttcctcaggcccaaccccaggcccgaaaattaaagggcagctcaaagctgaacctctggtcaagaaatcgggccatacggtccggccggaaactgaaccggccggctaaaaatacggcccaggccgccgttgaaattgcgaattatcctcgaaccagggtcgatgggtccgattctgacggagaagatgacggcgatattcgagaggggaaggcgatatacatggtgtctgacggaactgggtggacggcggaacacgccgttacggcagctttgggtcagttcgattattgcttggtcgatcatggttgccctgttaatacccatttgttttctgggatagatgatgtagagcgtctgatggaaattgtgaaacaagcagcaaaagaaggtgctatgcttgtctatacgcttgctgattcatcaatggctgaatctgccaaaaaagcctgcaaactgtggggtgttccatcaaccgatgttctgggcccaataacggagtcaattgcttctcatcttggcgcctcaccttcaggactccctcgtggtgctggaggtgtaaatgttcccctaagtgaagactatttccgaagaattgaagccatagagtttaccatcaagcaagatgatggggctcttcctcagaacttgcataaggctgaacttgtactcactggtgtatctcgaactggaaaaactccactatcaatttacctggcacaaaaaggatacaaagtggcaaatgttccaatcgtaatgggtgtggatttaccaaaaactctgtttgagatagaccctgataaggtttttggtttgactataaatccggtaatcttgcaatcaattaggaagtcacgagccaagagcctgggattagctgaagatgagacgactagctattctgaaatggactatgtgagaggcgagttggtgaacgcgactaaaatcttctcacaaaatcctaagtggcgggtcgttgaggtgactagtaaagccattgaagaatctgcagcagttatcttgaggctgtaccatgacagaaagcagaagtgtttgatgcccagaatatctaagcgctataacccaacttttctatacaaagttgtaatggatacttatagatatatttgaacaactttgtataataaagttgtaaaccgaatatctcttcgaatcacattcatatatatagagtcttgagagtatacacacttgaaaccgtttgtacatacatatacataccattgtgctatgttactcccaggttttgataccttagttttttttacctgcaaatcgatcaaaacccgattttctttgcggagttaccacccagctttcttgtacaaagtggttgataacagcgcttagagctctgccgagcacaattgatcggctaaatggtatggcaagaaaaggtatgcaatataataatcttttattgggtatgcaacgaaaatttgtttcgtcaacgtatgcaatattttttattaaaagagggtatgcaatgtattttattaaaaacgggtatgcaatataataatcttttattgggtatgcaacgaaaatttgtttcgtcaaagtatgcaatattttttattaaaagagggtatgcaatgtattttattaaaaacgggtatgcaataaaaaattatttggtttctctaaaaagtatgcagcacttattttttgataaggtatgcaacaaaattttactttgccgaaaatatgcaatgtttttgcgaataaattcaacgcacacttattacgtgggcgcgccttaattaaattaatggtaccggtacttaatcgaaaaaaaaacagacagccatgtgctcttcggccttaattaaggtgcgtttttatgcttgtagtattgtataatgtttttaagatcctagggataacagggtaatgagctcggatccactagtctcacaattccacacaacatacgagccggaagcataaagtgtaaagcctggggtgcctaatgagtgagctaactcacattaggctgaattaggcgcgcctatttctattaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgggggatcgatcccgcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaatgccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatcttattgccccccgggatcagatctggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctgatccgtcgagattaatagaaataaattcagcctaattcggcgttaattcagtacattaaaaacgtccgcaatgtggcggccgcggtatcactagtattacagaggtaagttataacagtcgcctaaccgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 70 - DNA, 3432 bp, Artificial Sequence
  Synthetic oligonucleotide sequence
ctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgcggccgcccccttcaccatgacaggaggctttaggaaatgcatggtgctttgttgtgcaagaaaactcccgaaagaaacaacaatgggaaccaccgcatacgacgaagccattacagggctgagcaagcttctcagtgagaagaaaggattggatgatgtagcagccgcaaaaatcaagcagttaacagcagagttgcagcagggcaccaagcaaaatggtgtttccgaaaacgggtttgacccggatgagcgcatcaaatccggattcatccggttcaagactgagaaatatgagaagaatcctgctctgtacggtgaacttgccaagggccagagtcccaagttcttggtatttgcctgctcagactcccgtgtttgcccctcccacatcttggatttcaagccaggggatgccttctcggttcgtaacatcgccaacatggtcccaccttttgataagacaaagttctctgggacaggggcagccattgagtatgctgtattgcatctaaatgtggagaatattgtggtcattggacacagctgctgtggaggaataaaggggctcatgtccatccctgattgtggcaccacttccacagacttcattgaagagtgggtcaagatcgctcagcctgctaggaccaaggtcaaagcagaagttagtagcgcagagttcacggagcagtgcaagaactgcgagaaggaagctgtcaatgtctctctcggaaacttgttgacatacccatttgtgagggaagcagtaatgaagaaaactctggcattgaagggtgcacattatgattttgtcaatggacgtttcgagctgtggaacctcgaatttggcctctcaccttctaccgcagtaaagggtgggcgcgccgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgc

SEQ ID NO: 71 - DNA, 3417 bp, Artificial Sequence
  Synthetic oligonucleotide sequence
ctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgcggccgcccccttcaccatgtgtgagagcttcaagagagaataccagctctgcgaggagatcggtcgaggccgcttcggcgtcgtctaccgctgctacaacccctcctccaccgaagattccgacactcctttggctgtcaagtccattgataagcgcctcctcctcgacgacgagaccgaccgtgagtgccttgacaaggaacccaaaatcctccaccttctctctcctcaccctaatattctgcagatccataacctctttgattctgatacccatctcctcattgttaccgatctctgccaagaggagaccctttacgaacgcattatctctaacggccccttctctgagcctgacgctgcggctattttctgtcagctcgccgaggccctcgctcactgccaccgcaactacgtcgctcaccgtgatatcaaaccagacaacatactattcgactcaaggaacaggctgaagctctgcgacttcggctcggccgagtggttcggagcaggagacagagagatgcgcggtgtggtaggaacaccctactacgtggcgccggaggtgctttccggaaaagactacaatgagaaggcggatgtgtggagtgctggtgttattctctacatcatgctcggtggagttccacccttctatggtgagactgttgaggagacttttgaggctgttcttaggggaaatcttcgctttccggccaggattttccgaaacgtttctactcaggcaagggatttgttgaggaagatgatgtgcaaggatgtttccagaaggttttctgctgaacaagtcttaaggcatccttgggtaaccagtggaggattggccaacatgaagggtgggcgcgccgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgc

SEQ ID NO: 72 - DNA, 5478 bp, Artificial Sequence
  Synthetic oligonucleotide sequence
ctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgcggccgcccccttcaccatgtcgactgtgaagctagataggcttacgtcgattgatgcccaattgaggctgcttgcacctaagaaggtctctgaggatgataaacttattgagtatgatgctttgctgctcgatcgcttccttgatattcttcaaaacttacatggggaagacatcaaagaaacggttcaagaattgtatgaacaatctgctgaatatgaaaggacacatgaccccaagaaattggaggagctgggaagcatggtgaccagtttggatgctggagattccattgtggttgccaaatcattttctcacatgcttaacctggctaaccttgctgaagaagtccagatttcccgtcgcaagagggtcaaaaaagtgaagaaaggagattttatggatgagaatactgcgatgactgagtcagatatggaagaaacactgcggaggcttattgtggatttgaagaaatccccacaagaaatttttgaaactttgaaaaaccagacagttgacttagttttcacagctcatcctacacaatctgttcgtagatccttgcttcaaaaacatggaaggataagggattgtttggcccaattgtatgccaaagacattactcccgatgataagcaggagcttgatgaggctctgcaaagagagatacaagctgcatttcgtactgatgaaatcaggaggactcagccaactccacaggatgagatgagagctgggatgagctacttccatgagacaatttggaatggtgttccaaaatttttgcgacgtcttgacacggcattgaagaacataggaataactgagcgtgttccctataatgcccctcttattcagttctcatcttggatgggtggtgatcgagatggaaatccgagagtaacacctgaagttactagggatgtatgtttattggctagaatgatggctgctaatatgtatttctcccagatagacgagctcatgtttgagctctcaatgtggagatgcaccgatgaacttcgtgaacgagcagaggaacttcacaaatattcaaagagagactccaaacactacattgagttttggaaacaaattccttccagtgagccttatcgtgttattcttgctgacgtgagggataagctctactatacacgtgaacgttctcgtcagttgttggcaagtgaggtctctgaaatccccgtcgaagcaaccttcaccgaaattgatcagtttctggagcctcttgagctttgctacagatctctctgtgcttgtggtgataggccagttgcggatggaagtcttcttgatttcatgcgacaagtagctacctttgggctttgtcttgtaaagcttgatattaggcaagaatcagagaggcatactgatgtgatggatgccattactacgcacctgggcattgggtcctaccgagactggacagaagagaagaggcaggattggctcttatctgagcttaggggcaagcgccctttgtttggccctgatcttcccagaactgatgaaattgctgatgttttggacacaataaatgtaatcgcagaactcccatctgatagtttcggcgcttatgttatctcgatggctactgccccttctgatgtgcttgctgttgagcttctgcaacgtgaatgtaaagttaaaaagcctttgagggttgttccattgtttgagaaacttgctgacctggaggctgctcctgcttctatgacccgcctattctccgtagattggtataaaaataggattgatgggaagcaagaagtcatgatcggatactctgattctggtaaggatgctggtcgtctctcagccgcttggcaaatgtacaaggttcaggaagagctgcttaaggtttctaagaaatttggggtgaagctcacaatgtttcatggacgaggaggaacggtgggaagaggagggggtcctactcatcttgctattttggcacagccagctgaaactattggtggatcacttcgtgttacaattcaaggtgaagtgattgaacaatcctttggagagcagcacttgtgttttagaacactccagcgttatacagctgctacacttgaacatgggatgaatccaccaaaatctcctaagccagaatggcgtgctctcttggaccagatggctgttgttgccacagaggaataccgctccatagtttttaaggagcctcgatttgtcgagtacttccgtctcgcaacgccagaaacggagtatgggcgcatgaacattgggagcaggccatcaaagagaaagccaagtggtggaattgaatctctccgtgcaatcccttggatctttgcatggactcaaactaggttccatctgcctgtgtggctgggcgttggcggagcacttaaacatgtccttgagaaagatataaggaaccataacatgcttagggacatgtacaacaatttccctttcttcagggtgaccattgatttgcttgaaatggtgttcgctaagggagaccctgaaattgccgctttatatgacaaactactggtgtcagaggagctgcagtcctttggggagcgtttgagggcaaattatgaagacactaaacgccgtctcctcgaggtcgctgggcataaagacctgctagagggagatccttacttgaaacagaggctccgccttcgtgatccctacatcacaaccctcaatgtctgccaagcgtataccctgaagcggattcgtgatcccgacttcaaggtaacagagaggccacacttatccaaggaaatcatggacgcacacaaggcagctgctgagctggtgaagctaaaccccactagtgagtatgctcctggacttgaagacacacttatcttaaccatgaagggtgttgctgctggtctgcagaacactggtaagggtgggcgcgccgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgc

SEQ ID NO: 73 - DNA, 3576 bp, Artificial Sequence
  Synthetic oligonucleotide sequence
ctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgcggccgcccccttcaccatggccgttgaacctcttcgcgttcttgtcaccggcgccgccgggcaaattgggtatgctctcgttcccatgattgctaggggaataatgctgggtgctaatcagcctgtgatcttgcacatgctcgatattcctccagcagccgaggcattgaacggagtgaaaatggagctggtggatgctgcctttccacttcttaaaggcgttgttgctacaaccgatgctgctgaagcctgcaaaggtgtaaatgttgctgtcatggttggtggcttcccaaggaaagaaggcatggagaggaaggatgtgatgtcaaagaatgtttccatctacaaggctcaagcttctgctcttgagcaacatgctgctcccaattgcaaggttttggttgttgccaaccctgccaacaccaatgctttgatcctaaaggaatttgccccatcaatcccggagaagaacatttcttgtttgacaaggcttgaccacaacagagctctaggtcagatctcagagagattgaatgttcaagtctctgatgttaagaatgtgattatttggggaaaccactcctcaactcaataccctgatgtcaaccacgctaccgtgaaaacacagggtgttgataagcctgttcgtgagcttgttgctgatgatgcatggttgaatggagagttcataacaactgtgcaacagcgtggagctgccatcatcaaggcaaggaagctctccagtgcattgtcagctgctagttctgcttgtgatcacatccatgattgggtgcttggaaccccagagggaacatgggtatctatgggtgtgtattctgatggctcgtacaatgtgccagctggaatcatttactccttcccagtaacttgtaaaaatggagaatggacaatcgtccaagggctgccaattgacgatgactcaaggaagaaaatggatgcaactgctgcagagcttgtcgaggagaagacattggcctactcatgcctgactaagggtgggcgcgccgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgc

SEQ ID NO: 74 - DNA, 4422 bp, Artificial Sequence
  Synthetic oligonucleotide sequence
ctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgcggccgcccccttcaccatggcggggaaattcggatcactgaggcagagtttcattgaaagaagcaaagagaggttgctatctcgaagagggtattcggagctagggttacctggctccgatggtgatgttgaagatgagggcaatagcgatgtcaaatgcggttgtttccgatcaatttgcggcgggagaagtcgaaattccgatagcggaaatcgatctaagggcggatgttaccggtggatttgtgatcggatattagggttctgtaatgggtttaaggaagttgcaggtaaattttatgagatgggtcgatctgatcctcgaaaggtgttctttgcagcgaagatgggtgggagcttagctttggtttcaatgctcatcttcttgaggggacctttatcggatattcgtcagtatgctatttgggctattttaactgtcattgtctgtttcgagtacagcgtaggagcatgtcttagtaaaggccttaaccgtggtctgggaacggtaactgctggaagtattgctttcgggctagcagaattagcagttcggtctggtgaatacaaagaaccgctcattattatgtatatgttcttcgcaggttctattgcgacctacattaaattatacccaacaatgaaagaatacgaatatgggtttcgggtattccttatgacatttgccatagtaatggtgactggaaataaaacaacaaattttttccaaactgcttttttccggttgttgcttatttcaattggtgctgtcatagcttcagtggttaacatatgtgtttaccctatttggtctggcaccgatcttcataaggtggtggtgaaaaatttcaagggtgttgctacttctttggaaggctgtttaaatggatacttgcagtgtgtagcgtatgataaaatcccttcaaagattcttacgtaccaagcttatgatgaccctacatatggtggctatagaacagctgtccagtcagcaagtcaagaagaaactctgttgagctttgcgaaatgggagcctcctcatggcccttatagatcatgcaattatccttgggaatcctatgttaaagttagtggggcactgagacattgtgcttttatggttatggcaatgcatggatgcattcttgcagaaatacaggcaccaccagagaagagacaggtttttgccgatgaacttcgcagggttggcatggccggtgctaaagtcatacgtgaacttgggaacaaagttgagaaaatggagaaactaagccccggtgatatacttgcagaagtacatacggcagcagaggagctgcaaatgagaatcgatgagaagtcttatctcctggtcaatttcgagaaatgggaagaaggcaaacgaccaaaggaatttgatgaccctgagcgtgtttctcaaatgaagagttatggaagtggtcagcttgttataaactccctaagtgaagcagtgctaagtattgaacccgagcagatgcaatcatacattgataatatgagttcaagggtttcaatgattggtgctggcccttcattgcaaggtatgttttccactgatagtatggcgactagaactcagtggccttcacgtctttcactcctaccagacctgagcatcaatgaaaaggaagcgaaaacatatgagagcgcaagctccttgtcactagcaacttttgcttcacttctagtagaatttgtggcaagacttggatatttggtggaggcctttgaggaactcagtgagaaagcagctttcaaggagcaaagtgagctagaagacgaaaaggcgagtaatgggctctggcataagttgatggtgtcccttcagttcagaaataagggtgggcgcgccgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgc

SEQ ID NO: 75 - DNA, 4227 bp, Artificial Sequence
  Synthetic oligonucleotide sequence
ctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgcggccgcccccttcaccatgaatcataatcacgatcccaaaactccccttctcccaacccatcatgatgatgatcatcaagggcggccaacacctgagcgttccacctcagttatcatgtcccttgccacacccaacacggccttcgtcctcctaggacccctcttgtgtacccttgtaatgttgtgtgtcaagttcgatgggaccgagtcgagccggaacatgctggctatcctggtctggatcttcacgtggtggctcaccgaggctgttccgatgcctatcacctccatgtcgccgttgtttctatttccggtgtttggtatcgcctcggccgacgctgttgctaagtcgtacatggacgatgtcatctctcttgtgcttggtagcttcattcttgctcttgctgttgagcactacaatattcacaagaggctggccttgaatataacattgttattctgtggggacccagtgaacccaccgttgctcctcctggggatctgcgccaccacagctttcgtcagcatgtggatgcacaacgtggcagccaccgtcatgatgatgccagtggccaccggaatcctccagagatttccatccacaagagaaggcggccgaaacgacgccgttgacaagttcagtagggcagttgtgcttggggtgatatactctgccacaattggtggtatcagcactctgactgggacaggtgtcaacctcatattggctggcatgtggaagagctatttccctcaagcggaccccatcagcttcaacacgtggctcttttatgggttcccattggctgtctttatcttcttctcgttgtgggccatactttgttgtttgtattgcaaacgtgggtcgggccgggtccttcaggagtatttggataaggatcaccttcaaagagagctcgacttgttaggtccaatgtcctttgcagaaaaaatggtattatccgtctttttggggcttattatgctatggatgacaaggaatctaaccgatggtatccctggatggggagctctatttaaagggagggccggtgatggcactgctagtgttatgatggcaactttgttattcataatacccaacaagaggagaaagggagaaaagctaatggactggactaagtgcaagaaactaccttggaacgttgttcttctacttggggccggctttgccatcgcagatggggtgcggtcaagcggcctagcggacgtgctttcccgcgccttggacttcctagagacggctccattttgggcaattgcacccatggtgtgtctcataggtgggatcatgaccgagttcacctccaacaatgccaccacgacattgttggttcctctgttgatccaaattgcacagacgatgcacgtgcatccgcttcttcttatggtccctggagccgttggggcccaattcgccttcttgcttccgactggaactccttccaatatagttgggttcaccactggtcatattgacatcaaggatatgattaaaactggtctccctctaaagattgctgggacagttgtactctcatttttaatgcctacccttggagcctacgtttttgggacaaacaacaaaccgctgatgtacccacaaagttggcgtagtttgtattcaaattcgggatatacaaagggtgggcgcgccgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgc

SEQ ID NO: 76 - DNA, 4335 bp, Artificial Sequence
  Synthetic oligonucleotide sequence
ctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgcggccgcccccttcaccatgggtggtagcaatgcattgaatgagatgaccaatggatctgatggtattactgggggtgttgctgatgtctatggtgaagagtttgccacccaggatcagcttgtcaccccttggagcttctctgttgcttgtggtcattcattgttgagagatccccagcacaacaaagggcttgcttttacagagaaagagagagatgcccacttcttgcgcggtctgttaccccctgtagttctgtcacaagagctccaggagaagaagttcttgacgactcttcgtcaatatcaagttcccttgcagaaatacatggccatgatggatcttcaggagaggaatgagaaactgttctacaaacttcttgttgaccatgtcgaagaactgcttcctcttgtttatacgccaactgttggtgagggatgccaaaagtatggaagtatttttagacgtccccaggggctattcatcagtttgaaggataagggaagaatccttgagcttttgagaaactggcctgaaaagaaaattcaagttattgtagttactgatggtgaacgcatactggggctaggagaccttggctgtcagggaatgggaatacctgttggaaaactttccttgtattcagcccttggtggagtctgcccatcagcatgcttgcctataacccttgatgttggcaccaacaatcagaagttgttagatgatgaattttacattggattgaagcagaagcgggctactggagaggaatatgctgagtttgtccaagaattcatgtctgcagttaagcaaaactatggggagaagatccttgtacagtttgaagattttgccaaccataacgcatttgagttgctggagaaataccgcaccactcacctcgtcttcaatgatgacattcagggtactgcttctgttgttcttgcaggacttattgcttctttaaaactactagggggaaccttggctgaccataaatttttgttcctcggtgctggagaagctggaacgggtattgcagagcttatagcccttgagatgtcaaagaagacaaaggctccagtagagcagatgaggaaaaagatttggcttgtcgactccaagggacttgttgttagctctaggaaggagacacttcagcagttcaaactaccttgggctcacgaacatgaacccattacaactcttatagatgctgtccaggcaatcaagcccacagtgttgattggtacttctggaaaagggaaacaatttaccaaggaggtcgttgaagccatggcaaatatcaatgcgaaacctctcattcttgctctatcaaatcctacttcacagtcagaatgtactgccgaagaagcctacacatggagtcagggacatgcaatatttgccagtggaagcccatttgaccctgttgaatatgaaggaagaacttttgtccctggccaggcaaataatgcttacattttccctgggtttggtttgggtctgatcatgtgtggtgcaatccgtgtccatgatgacatgctattggctgcctctgaggcactggcttcacaagttacaggagaacatttcataaagggacttatctacccaccattcaaggacatcagaaagatatcagctcacattgctgccggagtagctgcaaaagcttatgaacttggtttggctagtcggcttcctcaaccagccgatcttgttaagtttgccgagagctgcatgtacaaccctacttaccggagtttccgtaagggtgggcgcgccgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgc

SEQ ID NO: 77 - DNA, 5427 bp, Artificial Sequence
  Synthetic oligonucleotide sequence
ctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgcggccgcccccttcaccatggcgtcagctttcaaggggatcttgatcagatctccacctgatgtctgtgcagagacagtagcaaaagtgagccaatgcaatcgagctcaacttgttaagaattcgtccactggttttaaaaatatcttcaaattatcagaggccaggaaatttcacgctccagttgcaagtcatttgaggtcacaagccgtcatggccccagcctcagacccaacatcaactgcaataaagagagtattcacctttggtaaaggaaggagtgaaggcaacaagggtatgaagtccttgttgggaggtaaaggagcaaaccttgcagagatggccagcataggcttatccgtcccacctggattgactatttctacagaagcatgccaagagtaccaggagcatggaaaacagctctctgctggtttgtgggaggagatattggagggattgagagtcatagagaaggatatggggtcttaccttggagacccttctaagcctcttctgctttcagttcgttctggtgctgcgatttccatgccagggatgatggacactgtcctcaatctaggacttaatgacgatgtggttgcaggactggcagcaaaaagtggagaacgctttgcttacgactcatacagacgtttcctggacatgtttggtaatgtagtcatgggtatttctcactcatcatttgaagagaagttagaaaagttgaagcaggcaaaaggtgttaaacttgatacggagctaactgcatctgatctaaaagaggtagtagaacagtacaagaacgtctatcttgaagtaaaaggagaaaagtttcctgctgatccagaaagacagcttcagcttgctattcaagcagtatttgattcatgggatagtccaagggccatcaagtatcggaacattaaccagataacaggactgaaagggactgcagttaatatccagtgtatggtgtttggtaacatgggaaatacttcagggactggtgttcttttcactcgaaacccaagcactggtgaaaagaagctctatggggaattcctgattaatgctcagggagaagatgtagttgccggcattagaacgccagaagacttggacaccatgaggagctgcatgcctgaagcttacaaggagcttgtggagaactgtgaaattctggaacgacattacaaggatatgatggatattgaattcactgttcaagaaaataggctatggatgttgcaatgccgatctggtaaacgaactggtaaaggtgctgtgaagatagctgtagacttggtgaaagaaggaatagtcgacacttacactgctattaagatggtggaaccacagcatcttgatcaacttcttcacccacagtttgaagacccatctgcttataaagacagagtgattgctactggcctgccggcatctcctggagctgctgttgggcagattattttcagtgctgatgaagctgaatcatggcaagcacaaggaaagagtgtcattctggtgaggaatgaaactagcccagaggatgttgggggtatgcatgcagcaattggaatcttaactgctaggggtggcatgacatctcatgcagctgttgtagcccgtgggtggggaaaatgttgtgtttcagggtgctctgaaatccgagtgaatgatacagacaaggttcttttggttggagacaaagtaatatcagaaggtgattggctttcacttaatggatctactggtgaagttatcttagggaaagtaccactttcacctcctgctctcagtggggatctagaaaccttcatgtcttgggcggatgatatacgtgtccttaaggtcatggcaaatgctgacacaccagaggatgctttggcagcaagaaacaatggtgctgaaggaattggactttgcaggacagagcacatgttttttgcttcagatgataggattaagacagtgaggaagatgataatggcagtaacatccgaacagagaaaagtggctctggaccagctattgccttatcaaagatccgacttcgaagggatttttcgggcaatggatggtcttccagtgacaattagattgttggaccctccactacatgagttccttcctgaaggtgatgtagaacaaattgtcagtgaacttaccttggagactggcatggctgaagatgaaatcttttccaggattgaaaagttgtcagaggtcaatcctatgttgggtttcagaggctgcaggttggggatatcatacccagaactaactgaaatgcaagcacgggcaatcttccaagctgctgtttcaatgagcaaccagggtgttaaagtttttcctgagataatggttccccttgtaggaacgcctcaggaattaggacatcaagtgagcttgatacggaatgttgcagaaaaggtattctctgagacgggttcctccttgagttacaaggtgggaacaatgattgagatccctagggcggctctggttgcagatgagattgcaatggaagcagaattcttctcttttgggacgaatgatctcacgcaaatgacctttgggtatagcagagatgatgttggcaagttcctccctgtatacttgtccaagggcatacttcagagtgatccatttgaggttttggaccagaaaggtgtgggccaactcatcaaactagcaacggagaagggccgtagtgcaaggcctagcttaaaggttggcatatgtggggagcatggaggagaaccgtcatctgttgcatttttcgcggaagcaggattggactacgtttcatgttcccctttcagggttccaattgcaaggctggcagcagctcaagtcgttaagggtgggcgcgccgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgc

SEQ ID NO: 78 - DNA, 3789 bp, Artificial Sequence
  Synthetic oligonucleotide sequence
ctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctccgcggccgcccccttcaccatgttagcttgtgctagcctcggcctcccaaaaacccaaccgccaccgccactagtttcaccggcacctgaaccaagccgtccggccccagccccatccgtttctctctcctctgactcagcaacctcacttcctcaggcccaaccccaggcccgaaaattaaagggcagctcaaagctgaacctctggtcaagaaatcgggccatacggtccggccggaaactgaaccggccggctaaaaatacggcccaggccgccgttgaaattgcgaattatcctcgaaccagggtcgatgggtccgattctgacggagaagatgacggcgatattcgagaggggaaggcgatatacatggtgtctgacggaactgggtggacggcggaacacgccgttacggcagctttgggtcagttcgattattgcttggtcgatcatggttgccctgttaatacccatttgttttctgggatagatgatgtagagcgtctgatggaaattgtgaaacaagcagcaaaagaaggtgctatgcttgtctatacgcttgctgattcatcaatggctgaatctgccaaaaaagcctgcaaactgtggggtgttccatcaaccgatgttctgggcccaataacggagtcaattgcttctcatcttggcgcctcaccttcaggactccctcgtggtgctggaggtgtaaatgttcccctaagtgaagactatttccgaagaattgaagccatagagtttaccatcaagcaagatgatggggctcttcctcagaacttgcataaggctgaacttgtactcactggtgtatctcgaactggaaaaactccactatcaatttacctggcacaaaaaggatacaaagtggcaaatgttccaatcgtaatgggtgtggatttaccaaaaactctgtttgagatagaccctgataaggtttttggtttgactataaatccggtaatcttgcaatcaattaggaagtcacgagccaagagcctgggattagctgaagatgagacgactagctattctgaaatggactatgtgagaggcgagttggtgaacgcgactaaaatcttctcacaaaatcctaagtggcgggtcgttgaggtgactagtaaagccattgaagaatctgcagcagttatcttgaggctgtaccatgacagaaagcagaagtgtttgatgcccagaatatctaagcgctataagggtgggcgcgccgacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgc

SEQ ID NO: 79 - DNA, 14324 bp, Artificial Sequence
  Synthetic oligonucleotide sequence
gtttacccgccaatatatcctgtcaaacactgatagtttaaactgaaggcgggaaacgacaatctgatccaagctcaagctgctctagcattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagagttatcaacaagtttgtacaaaaaagctgaacgagaaacgtaaaatgatataaatatcaatatattaaattagattttgcataaaaaacagactacataatactgtaaaacacaacatatccagtcactatggcggcccctcgaggggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgataacagcatgttacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaagctagcggaggaggtgccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgtgagcttagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggttccggaaccaattcgtaatcatggtcatagctgtttcctgtgtgaaattgttatccgctcacaattccacacaacatacgagccggaagcataaagtgtaaagcctggggtgcctaatgagtgagctaactcacattaggctgaattaggcgcgcctatttctgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggatcatccgggtctgtggcgggaactccacgaaaatatccgaacgcagcaagatatcgcggtgcatctcggtcttgcctgggcagtcgccgccgacgccgttgatgtggacgccgggcccgatcatattgtcgctcaggatcgtggcgttgtgcttgtcggccgttgctgtcgtaatgatatcggcaccttcgaccgcctgttccgcagagatcccgtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcatcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccagatccggtgcagattatttggattgagagtgaatatgagactctaattggataccgaggggaatttatggaacgtcagtggagcatttttgacaagaaatatttgctagctgatagtgaccttaggcgacttttgaacgcgcaataatggtttctgacgtatgtgcttagctcattaaactccagaaacccgcggctgagtggctccttcaacgttgcggttctgtcagttccaaacgtaaaacggcttgtcccgcgtcatcggcgggggtcataacgtgactcccttaattctccgctcatgatgaattcagaaataaattcagcctaattcggcgttaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaattcgggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctagctagaaattcgttcaagccgacgccgcttcgcggcgcggcttaactcaagcgttagatgcactaagcacataattgctcacagccaaactatcaggtcaagtctgcttttattatttttaagcgtgcataataagccctacacaaattgggagatatatcatgcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagggtgccttgatgtgggcgccggcggtcgagtggcgacggcgcggcttgtccgcgccctggtagattgcctggccgtaggccagccatttttgagcggccagcggccgcgataggccgacgcgaagcggcggggcgtagggagcgcagcgaccgaagggtaggcgctttttgcagctcttcggctgtgcgctggccagacagttatgcacaggccaggcgggttttaagagttttaataagttttaaagagttttaggcggaaaaatcgccttttttctcttttatatcagtcacttacatgtgtgaccggttcccaatgtacggctttgggttcccaatgtacgggttccggttcccaatgtacggctttgggttcccaatgtacgtgctatccacaggaaagagaccttttcgacctttttcccctgctagggcaatttgccctagcatctgctccgtacattaggaaccggcggatgcttcgccctcgatcaggttgcggtagcgcatgactaggatcgggccagcctgccccgcctcctccttcaaatcgtactccggcaggtcatttgacccgatcagcttgcgcacggtgaaacagaacttcttgaactctccggcgctgccactgcgttcgtagatcgtcttgaacaaccatctggcttctgccttgcctgcggcgcggcgtgccaggcggtagagaaaacggccgatgccgggatcgatcaaaaagtaatcggggtgaaccgtcagcacgtccgggttcttgccttctgtgatctcgcggtacatccaatcagctagctcgatctcgatgtactccggccgcccggtttcgctctttacgatcttgtagcggctaatcaaggcttcaccctcggataccgtcaccaggcggccgttcttggccttcttcgtacgctgcatggcaacgtgcgtggtgtttaaccgaatgcaggtttctaccaggtcgtctttctgctttccgccatcggctcgccggcagaacttgagtacgtccgcaacgtgtggacggaacacgcggccgggcttgtctcccttcccttcccggtatcggttcatggattcggttagatgggaaaccgccatcagtaccaggtcgtaatcccacacactggccatgccggccggccctgcggaaacctctacgtgcccgtctggaagctcgtagcggatcacctcgccagctcgtcggtcacgcttcgacagacggaaaacggccacgtccatgatgctgcgactatcgcgggtgcccacgtcatagagcatcggaacgaaaaaatctggttgctcgtcgcccttgggcggcttcctaatcgacggcgcaccggctgccggcggttgccgggattctttgcggattcgatcagcggccgcttgccacgattcaccggggcgtgcttctgcctcgatgcgttgccgctgggcggcctgcgcggccttcaacttctccaccaggtcatcacccagcgccgcgccgatttgtaccgggccggatggtttgcgaccgctcacgccgattcctcgggcttgggggttccagtgccattgcagggccggcagacaacccagccgcttacgcctggccaaccgcccgttcctccacacatggggcattccacggcgtcggtgcctggttgttcttgattttccatgccgcctcctttagccgctaaaattcatctactcatttattcatttgctcatttactctggtagctgcgcgatgtattcagatagcagctcggtaatggtcttgccttggcgtaccgcgtacatcttcagcttggtgtgatcctccgccggcaactgaaagttgacccgcttcatggctggcgtgtctgccaggctggccaacgttgcagccttgctgctgcgtgcgctcggacggccggcacttagcgtgtttgtgcttttgctcattttctctttacctcattaactcaaatgagttttgatttaatttcagcggccagcgcctggacctcgcgggcagcgtcgccctcgggttctgattcaagaacggttgtgccggcggcggcagtgcctgggtagctcacgcgctgcgtgatacgggactcaagaatgggcagctcgtacccggccagcgcctcggcaacctcaccgccgatgcgcgtgcctttgatcgcccgcgacacgacaaaggccgcttgtagccttccatccgtgacctcaatgcgctgcttaaccagctccaccaggtcggcggtggcccatatgtcgtaagggcttggctgcaccggaatcagcacgaagtcggctgccttgatcgcggacacagccaagtccgccgcctggggcgctccgtcgatcactacgaagtcgcgccggccgatggccttcacgtcgcggtcaatcgtcgggcggtcgatgccgacaacggttagcggttgatcttcccgcacggccgcccaatcgcgggcactgccctggggatcggaatcgactaacagaacatcggccccggcgagttgcagggcgcgggctagatgggttgcgatggtcgtcttgcctgacccgcctttctggttaagtacagcgataaccttcatgcgttccccttgcgtatttgtttatttactcatcgcatcatatacgcagcgaccgcatgacgcaagctgttttactcaaatacacatcacctttttagacggcggcgctcggtttcttcagcggccaagctggccggccaggccgccagcttggcatcagacaaaccggccaggatttcatgcagccgcacggttgagacgtgcgcgggcggctcgaacacgtacccggccgcgatcatctccgcctcgatctcttcggtaatgaaaaacggttcgtcctggccgtcctggtgcggtttcatgcttgttcctcttggcgttcattctcggcggccgccagggcgtcggcctcggtcaatgcgtcctcacggaaggcaccgcgccgcctggcctcggtgggcgtcacttcctcgctgcgctcaagtgcgcggtacagggtcgagcgatgcacgccaagcagtgcagccgcctctttcacggtgcggccttcctggtcgatcagctcgcgggcgtgcgcgatctgtgccggggtgagggtagggcgggggccaaacttcacgcctcgggccttggcggcctcgcgcccgctccgggtgcggtcgatgattagggaacgctcgaactcggcaatgccggcgaacacggtcaacaccatgcggccggccggcgtggtggtgtcggcccacggctctgccaggctacgcaggcccgcgccggcctcctggatgcgctcggcaatgtccagtaggtcgcgggtgctgcgggccaggcggtctagcctggtcactgtcacaacgtcgccagggcgtaggtggtcaagcatcctggccagctccgggcggtcgcgcctggtgccggtgatcttctcggaaaacagcttggtgcagccggccgcgtgcagttcggcccgttggttggtcaagtcctggtcgtcggtgctgacgcgggcatagcccagcaggccagcggcggcgctcttgttcatggcgtaatgtctccggttctagtcgcaagtattctactttatgcgactaaaacacgcgacaagaaaacgccaggaaaagggcagggcggcagcctgtcgcgtaacttaggacttgtgcgacatgtcgttttcagaagacggctgcactgaacgtcagaagccgactgcactatagcagcggaggggttggatcaaagtactttgatcccgaggggaaccctgtggttggcatgcacatacaaatggacgaacggataaaccttttcacgcccttttaaatatccgattattctaataaacgctcttttctcttag

SEQ ID NO: 80 - DNA, 1559 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctgatttctatcaatgaaagtagacgttaaaaaaaaaaaaagatatcacagtacgtggaaacacgtgacacatattttaaagggaaaatataaacgtgaaatgcgtggaaactggcaagtagactattaatatttatgggcctatagtggttatatcaggctttattgggctctctatacgaattaaaagcctcaaacaaataatagaacttgaattgtaggcttttgtacccaccaaactggccgccggtgaccccctctcacgccgtatctctttttctttttcttgtttttttttttttttttttttttttttttttttgtgtgcgcgtatttgtttcaccatcaaaaaattaattttgttttaagtgttttattttccttcgttttgtttaaagtgtttaaaatcgttagttcaatgttgaaaaatatacaataatagaaacaattgtgacttttgtaatttgaatgaacaaaacatataacaataagtcctataatataaacattttaatttacattttcaactttttctcattttaaatttttattcagttgaaggcttgaagcgttggactactttagagaaactttacaagaacgttcttaacatctttttttctttcctttttgaatatcaaaatcagttaaaaacacttttgatctcacagaaactgatacaaagccgacggaaccgaccagattaggtcaaaaacgtaaaagacgcgcaaaaagaaaagaaaataactcataatagaatgttttagtcagaagaaaaaagtacaatatgaccaacgtaaacaaaaaagatgttgacgacataaagaaaagagctacagagacaaaggcattaaaatatcttttgtcgaaatctgaagatatttccttaagcgcgtttgcttctctgtctcctccattccattctatatcatctctgtctttgctctaagctttcctgtcaaaacaaaaattcaattccccacgtctgtcttatccacaataaaaccgaccttagcttagcttagactcattactcatttcacaaaaacagagagagaaatagagagacatactttacaggtaataattatcttgtttaattgtattatatatctctaactaaatttgggataaaaattgtctattcttgatcattcctctctgtatctctctgcttttgacaccttctcttagctgttttttcatcttttatctctgtttttaaaatcttttggctctttcgaagggtttcgagtccttttgagttctttgggcttcctcccaaatttctccacgagctcgacccctttcgtatcttccttctcatttttttgccaaatttattcgatccgtctttcactacccagctttcttgtacaaagttggcattataagaaagcattgcttatcaatttgttgcaacgaacaggtcactatcagtcaaaataaaatcattatttg

SEQ ID NO: 81 - DNA, 1164 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctttcattaaaaaaatatttttatactatataaagaaagcagaaaaacacagtttaattgcttttttcaagttccatatcatttttagtgtatatttattgcccttttataaatgaaattaggaaatttggatcaccttatggtcaatttctttatttttttagttataccacatttatactactgatgatgaaaatcgattttttgtatcgtgaacacttattaactggttttatcttgaataataaaacttccatagttattccgttattgttaggtcattgtaaaaaatcatcagcaattagtcattaaatatactatcaaagcttgtcagtcatttctcatcaattctagcaaaattattcgatatatccaaatccaaatgtcttggtttggtcatgactcatgaccgtggaaataagttcaagaatgcaaaaagtaacttatttgtgggacagaatcaaattctttgatccagttacttacgtctttccgtagccaatcaaattgaaatattttctttaggggtattcgattatggtggtcctgaagcctataacaattgttttccgataagatttgatatatataaataagggaacaatccccaaaaatgatatctagttaagatagtcgtagaatttacagaaaaggctacttatgtttttggcctgataatgcaaatactttcaaaatgttttatttgctaactagcttttagtttcgttctcgtatctaaagttagagattaacttactattcttgtattacgataacgttttgaatgaacatgtaatgatgcaagggtgtaaccaaaaatgataaaactttggggtcaatttgataatattgactaatagtgtggggcttgacaagaaccggaaactccatgatatttttgcagtctaaatatcttttcatctctcttctcttcctccactgaaatattccccacaagaactaacaacccagctttcttgtacaaagttggcattataagaaagcattgcttatcaatttgttgcaacgaacaggtcactatcagtcaaaataaaatcattatttg

SEQ ID NO: 82 - DNA, 1700 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctctgaaatttagtagagaaaaatatatgtttttttctacatacagaatagtttgaatttttaaaatcggatttgaattttaaaaatagaaatagtgtttgtaagtaaaaaatatattgtactatttaagatgtatagaaataaaatattgttctatactattttcataactgatttgtaaatcaattttaattttagtatagagcaaaatgttttaaatataaagtaatagtgttggtagtggtgatgagatagtagtttatgttacgttaatatagcattataatcaattaaatgtttttgttggaaggatactaaaccctaagtggataatatattgggaacccaaagatttcaatctaaaatttaatattctttaaccatagaaaaatagaataatatatgtttgtcatcactaccaacataacgagtagcacagcacaagatagtctcttggtagaggaaagaagtggtagtagagaacaccgggtacaccatttgggttccacaatcgagggcacaaggagacacgaactcgccacacttaactagaaattgatgtaactccaaaaaaatccaaaattttacctttgtaaatcaaaacccccaattcaatttaatcacaaaccctagacgtcaattccaaaaattaaatgtattgattccgtcgccaatacatctccattgaacgttttcagaatccgaagctttacaaaaaggagatagtaatttttgggacccaaaaagctgttggaatgttaacagctgatgagaaagtgttttttggaaagagagaagaagaagaagaaaaagagcctgtatctcaggcaaagggtagcattgtcattattacagaaaatacaaataatatcagtatctttttgtgggatggttagttacttaattataatttttttgtagattaaaaactcaaatttctcaaaattatactctcctaagtagaaaaattttacaagtttgatttcttgaaaattgatattataatttatttttctgattagggtgggaagattctttataatttttttggtttacctgaaaatgaaagaaaagattgtaagaaagatacaacaagtgtagactggatcttttaaagtccaaaccaaaagccaaaaattaggtaacctaaatatgtaagactttattttttggtttttcttattaaaacaacatttcgataattcattatgatattttttacgctatgatcctcagccttaaactttcattcgtatagaaggataatatcataatagtacaactcttttaattgccaccaatcaactttattgtctgctttcaaaaattttattttttataaaatattattcattttagctataactcaatttggaacttttattcgtcccaaataaaatatctttccaagagagatggaaaaatagcttcatatagagatattttcaacaacttgtccctctctaaactcatccaccttccaaaacagagaaggggaaaatacccagctttcttgtacaaagttggcattataagaaagcattgcttatcaatttgttgcaacgaacaggtcactatcagtcaaaataaaatcattatttg

SEQ ID NO: 83 - DNA, 1103 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctctctttctaatttcaggttataatttattaattttggcggagtaaaagtagatgaccgttacaagtctgatttattagactgtgaaattggaccgttgttatgtgggccatggcttttattaaaaaaagaagagaaggtatattatttaaattggagataatgggccgttttaaacccaattattattggtccactaaagtttttatatcctctaacttcgacgagcttgatatagttttggaccttttggtgtgaacggtcacattcaactaaattaaaaagtccaacaaacaaaatctggtcatgaaaagcttggtgtgatgtttctaataagtaaatttactgaggttaattggttggtttaacttaaatgtaatccaaactcctctccctttagagattttcagttgggaatgaaaacctttaaagcttgcaccctaaaatgacattaatggttatagatatagtttgttttcatgtttcttttttttttatattttcctttagttttttctagggttgggactaaataatcggactcggatccgagatccgatttgaaaagctggatacccaattgggatggatccgcttccggatcctgaatttttagattcagatgaatatttttttttaaactaaagaaagcatatcagcatcacatttttgtggtgatactgcttcaagaatctgtcacatatctgtccaaaagaaaagaatttgtcacatattgtataattttaatatatttattgttttagtttgaaaacaaacgtggaaaaaaacatcttacaggtgtcaggtgtgccgcgtcgtcccactcaaagcctatatcatcaattttctggctgttctaatctactcaatttatttttttattgttaatttactgaagatcggcgacccagctttcttgtacaaagttggcattataagaaagcattgcttatcaatttgttgcaacgaacaggtcactatcagtcaaaataaaatcattatttg

SEQ ID NO: 84 - DNA, 1700 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctttttaaatatctgtattttgcctccttttcattctattttgtttgatacaaacgattgtggtttgtaatgttaaaattaggaatgttattgaatgatatgtatatttcataaaaataataataataaaagtaggatgaatagtaaaattccaaggcatttcataatttacccattacatggtcaaaatttatcaatattttaaaataataataatcatccaatcaagattttgggaatagaatatcttaagaacttagtataattacatatatatatatatattcccttttaaatgtatcaaaaacaaactaagaacatacaaggaatttgatgtagtactatacaatttacatgcaaacagatgtagtactatttgatgacaaaaaaaaaaaaaaagatgtagtactattttatcttttcatcggaataattcggtcatgaagctattaattggttttaatgagaatttattataacagttgttgccacactgtcgaaatactaacgcctaacggctagttaaataattaacacgcggtgagaagtgagtgagttacacgaaccactaagaatctaatataggaagataagataagcatttcacacgtgtggtgtggacaatttaacagtgttaacacgcgcatggcatgtgatctagaaattagaacattaattttagcgttttgactttgacctttgaatcactaggcgtaggtatttacacgtgtaacaatataatttttttcaatatgtgatgatcatgggccaacgtttgtgggtaaaggtgtggtgttcgatcatgatccacttaaatttactgaattttagaattataacagcagaaggatataagtaatataccaaacttaactataatctacctctccttgtctatgtatactaaatgtctaacatgtaacacaaagctgtacaaaatttttaactctcaaattttttgaaataatgcaaagctgtaaaaatagctgtacgagaaaactgtacaataaaactgaaaataaaaaaatttgtaacgtttttgataaaagttttgtaaatgtataaccatcaaaactgtacaacttccagctttgataatgaattaccattcaaagctagagtttcgaattttttcattgtatacaaccatttgaacacaactcttttcaattatgccatacatacatttagttaataaattttaccgattaactagtactgacaaaagaaacaaagagtaattatatttttttgataaattgttttattagaaaaatacttaaaattgataaaaataaataaacccaattgatatatttgatattacaataccagatattgaaacaaataagacatgttttgtctatatacttccaactagaagatatttatttatccatatcctagatattttaatgtgtgaatctaatacattctcttatatacgaccaaatagtaaaacaatatgcctctcctgcaatttttcttcatccaatatttctacccagctttcttgtacaaagttggcattataagaaagcattgcttatcaatttgttgcaacgaacaggtcactatcagtcaaaataaaatcattatttg

SEQ ID NO: 85 - DNA, 1321 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctgaacagataagtgaagtttctctgcgatttttctaatgttgaatccatcaaactaataagtggtccctaaacctacatagtcgatggtaaaatgtcaataatgtttgaaagtttagataataccctgaaaatgacgagtcccttcgtttacttgtaataatgggtgagaactacgacacagttccatagcaactttcatatttcgagaattaaattatattccgcagcaaatgctatgtccttgtaaagctctgtttttagtctatgaccatacttgtaaaacatgttgtttttttttgtgtgaattaacagttcattcaaaataaaaataaataaataaataatcgaaaatgtaactctgtggttattgtagcttgaaaaaacgaataatcaagtgtgttgttcattctcttcgttcgttgcacactggtatagcttgttgctgtcatctactgctgactccagcgataatgaaacgatcagaaccacgaaatttactagaactcagcttatcggaacttggaaggggaccagatgagtattaggctaattcgtcgtgttgtatttttcaactaatgcgtcagtgtcgtttttattttcaactaatgcgtcagtgtcattagtttcggaaataaacgatatttgttttgtttttgtattgggtcctatatcgagcgagattggcatgtgagttgggttggctagggaaaatggtaaaatctccacattttgttttgaaaatgtgaaaaatacatttttccctacagcggggatatgaatcagtactatttataatgcaagatatgtaaatttaaaagacatcataagaaaaacaaaactacagaatttcgcttaagctttcaaagatatcgatttgaatataatggtgcatttgcggggttcagtttccacggaaccggtaaatttaaaagccaaataccttaaaagagttgtgaaacagggttacaaatatacatagtggattcgtatgaaaaagaagggaggaatgagtcctacacgtagtcacatcacatatgaaagagattgcttttgaaaatcgaatcctcttctaatattaaatctttcaagactggaggttttaaacaagaaaatcaaactcgacccagctttcttgtacaaagttggcattataagaaagcattgcttatcaatttgttgcaacgaacaggtcactatcagtcaaaataaaatcattatttg

SEQ ID NO: 86 - DNA, 1700 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctttaataaattagtaatgaacacctagactcgtatcttctaatctcaatgtttaatgaatggtaaaaataattatttaattttccgtggtcaacaatgcataatctttttatttattttgtcttcttacctttcaaaaatttctcaacttgtcaacagaaaaaataaaaatcccaataacaaaggtgacaaccgaaacagaagcacatgaccacaatgctaaagatggataaaaaaaatagagcaaaaagaaagacaaaaatttcagtagtcaagagtataattaagcacgtataatttgcaaaatttttattttatttttatgaaccgtttggtgtatatatataatccttgctttccagttttgatgatctttttgtgctactttgtatgcggttaaagattgttgtaataggcaaagaaatcttaagtaatgcctcagctgttaaacgttgtgatctcctctgttcaaaatatttcaagttgatcttacttatggtaatgctctactcgtgattgtgagtttgaactagtcactgttaaggttttctttataattgattgtcaagctaatgaataagtttgtgaatgaggttttagaaagatgcatgattggaagttgtgtttagtaaatgcttctcattacaactagaatttactatagaatcatagaacggccataaccaaacttcatgagtccggtgatattattggaatagaattcacataattttcatacttttgttacttagactgtctacataatgccacataatgaaaatttgaattagaaaacttgaatactaaatctacagatatttcaagtgacttctaatgtatgacaataagacattaagaccccttccatatcatgaccatttcaaactcgtgtcaatatgtaacccatttatcgtgggccataaacccaaaataataaatcatgtatataaacgggctattgggccataaactagtgataataagctttggggcgacgatctctggatacgtcacccctcgcgatacaattacaaccgatcaaggtcagcgaatactccgacatccttttcttgcggcccacatcggtctttagtgaatcacatgttttttctattgtcgtttcttgcgcatcaagttctgctgaggtttcttgttattttatttttgaaatttttcaacacctttaacttatctcgattttgtttaccacttaaaaaacgcccaaccaatggcatacactgaaaatgttttctaaacatttaatatttctgtggctaccaaaaagaaatcaagagttattttccatttattctgggtgaaagagaaacagagtgccacctgtcatttcctaatctggcacgtaggtttttctcatacgtattacagtgaataatacagtataccaaaggcggctcgtagcagagtttgttcgattctcttaaccacattaggtttggagtattatttgcttctctcgattgaagaagagtacctaaagaatcacccagctttcttgtacaaagttggcattataagaaagcattgcttatcaatttgttgcaacgaacaggtcactatcagtcaaaataaaatcattatttg

SEQ ID NO: 87 - DNA, 1700 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctaccgcttaatatcgtatgattagtattaaaaatcttctccagaatttcaacgttgtttttgctactcacgcattgtaccttaaatgatcttattcatcatttctaacaaaacaatttatgcattcttcgccagtagaagaacctagtagagtgctatcggcaacaactccgtcttgttcatgcggatgcaaaagaagacgtccatgcccacgtccacgtccatgtccacctccacgtccacactattcaagaaattatacagacccttgaaaaagaagaatgaagaagagaaaacaaggatcaattatgggattggtacaatatagttgagggtattgtctaatgtagtacttttgaatatgcttatagatttagacatattaaagactattttctccttttaaatcaatgaagaaaatacttgagttcaatccttcttttgcctttgcataaccgtctctcatccacaccaacaaaacaaatcccagaaccttcttttgcagaattttaaagacacacaaagcaatgaataagaacacttggtttacaataacgatcgaaactggtttacaataatgaccgaatatggtttgcaaatatagatgaattggaatttaattgattcgatctatatctaaaattaaatttcttgggttccctaaatactatcctcttagggtttagatttctattatcaaaactctcgtttaatttgagcaaattggttaatcggagaggttagggaaaacaacgttttctggtataaagagacgagagaaacggtattgatggagttaaaagtgatgatgttgatgaaatactgagtcaacgttaataaggcaagagccgactgtgagaagcaaggtttcatggttgggaattttgttgcgcaacggagaagatgaagtgaattttgttgcgcaacggatttccgcaagcttttcccgagaaaacaaagatatcatctacattctatttttgtgctgtaacttttctgaattttttgtaaacaattttttgtgatatatatatatatataaacaattttatatcattaagtatggtactctttaatgtttttaacggaacatgaccaaaactgctagtgaaagcattttgtcttaactttacaaaagaagttatcttttttttaacacaaactggttttcttcggtaaataaaaagactaagtttgtaaatttattcttagacaattatttactattattgccgactaatatgaaaatgcaaagaagtcgtatttggcattatccaaaagaagggacaaaacacttatctcttaaaacttaaattttaagccattcgtttaccaacaatgaatcttgtggctgatgtagaaaccgcgttcacttgtcaacatttagaaataatgttggctttcaaagaattaaatagaaacaaccaaaatgtatgaggttgagcgtcttctatatatttattacaagacttgcgatgaccaaaaacgcaacgaagaacgaaacccagctttcttgtacaaagttggcattataagaaagcattgcttatcaatttgttgcaacgaacaggtcactatcagtcaaaataaaatcattatttg

SEQ ID NO: 88 - DNA, 1543 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctagcttatagcgtagagatgattcactgatgttagtttcattcctatggaataacaaaatgcttttgatggtatcttcatgaacatgtacgttcacaactatctttgtagctctataactatttggtaactccggtttaagcaaagttctacactttaataatatcgacttcgttaatatatacaaatgaaaatagtcttatagatgcgagagcaaatgtttgagggtaggttaaaggaatcttgagatatggataaacgacactaagttgtgtcgtagcgagacagatccaaactacgacaagtagtaaacggagataataatatccaaaccataagaatccatgaaagcaagtagacaactgcgactttgcctcaccagtcaccatactaataattggagaggtggatctcttaggaatatttacttttataaaagatcagaggctagtcagaactcagggactaaattttattttcagtagtgacatctttaaaagacaacagagatttataaaactccacgtgtacagaagtgaaacagtctgacatgatgcctgatgctaactaactatgtaagataagacatatcttacatagttagttaccatgtaatagtaagtgataacccaaaaatgcaaaaaaaaacatccaactagaacatgtgatatgtcagtatgtgtatgagatcatgtgcacaataatattatcggtatttgtatgtctagttgtctacactctacagctcttactggaaatagattttgaggaacaagaaatagttgaatgagtcattgctatcttctagattttttttttttctgtcataatatcttctagaattttattacttgggaaagcgatatatgatatattctttttccaaaatttactaattaaaaaaaaaaaaaaaaactaagcactctgtatttattgccatattgaaaatgctctttccaccaatattccttatttgcctcaaatcattactttcggattctactgtcttgaactgtgttcatgtgtgtattccctcatcaatcaccttcaattcatattttcctatttccaaaaataaaaagatacagtatctatgtatttaattatatatcatatcaattatatcataataatcataagatcctttttatcgaaataaaaaaggaaacaaatccaatcatagcaagctttttcttttatttaataaacaaaaataaaaagcttcccgaaatggttaaaatccagaaccactaaagtcaaccaaatttgtcaaattcatccacgtcatcagttccatctataaaacgctcacgccattcgtcaagtcccaaaacaagagtccaccacccagctttcttgtacaaagttggcattataagaaagcattgcttatcaatttgttgcaacgaacaggtcactatcagtcaaaataaaatcattatttg

SEQ ID NO: 89 - DNA, 1700 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctagtaaagagaatgattattgagaatttgagattgactttatatatggtttagacacggtttagacacggtttagagcttgatttagtcataaaagagtcaagtggttgaggtgtgaacttcatatttaaagtgacgaatatcaaaagtatatagaatagacgtgtacctgcggtttaataattcctattaaaattcaccaatacattacgtgtcaaattgtatcctacagtatttagatttataatatatgcatcgctaccaaatttatggacacgttgatccactttcaaagattctgttttcggtaatagatttagaatccagatctcacctaggcttacaaaaacaaaacttacaagatccaaaatatattaaaagacgatttaaacaaaaaccaaatacattagaagcaaaatgtgaatttcgaggttctagcttaaaaataaatcgtatatactaataatggtcggttaaatggctggtcaaaaaaaaaaactgatattaagaaactagaatgtttaaaaatattttaagaaataaaagtgcaataagctaatattggccggtgttattaaaaaataacatactatttccacaatttgatctctcatttgtctttttccatctatttttatttattatgatagaaaatcatattatccaaaatatttttaaataaatgtaagagaattaaaaataaaatggtctaatcgaaggtaggtttagccgtttaggtgagaaaagagcttacttataccttttgataatgtgttcgtcaaaacagaacctataaagccaacctccaccgacccatcttttcttcttatattatttactccaagtttccttccaatttcaaaaaatataatcatctctctcactatctgaattttaaataacatacaacaaatatttttaatatatagaataaaatcaaaataagtcatcatgatctcaacatcagttgactagtcataagagaatttcataacaaaaattgaacatacacacacccaagaaaagaaaataaacttttttatttatttataatcctaagaaaaaaatggtttgtgatctaagaagttggagatagatagatgcatctccattaagagcaaaatgtttgtttttaaacagaatatgtgtccacacgaaacaacaatactctaaataggagatgcaaattgcatgtaaacactaattcagccaataacttcgaataaacaaccaaataataatacttactaattttgtttcccttcatccaaacttttctgcgtgtattattattatcatacagatttgatattaaatattacaaatatcttatttgtttgcaatattattatataagtaaagatgtatatcataatgtatgtatcctttatgtgtctctattataacgtggatcaagattctttcttatcttcatcactccacacattttcttgtcttcaaactcacacaaagaaagaaaagtctccaaagctcaaaaagcaacccagctttcttgtacaaagttggcattataagaaagcattgcttatcaatttgttgcaacgaacaggtcactatcagtcaaaataaaatcattatttg

SEQ ID NO: 90 - DNA, 1584 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctaaagaagagagaggaaggagaagagaagaaaaagaagagagacacaacggagcgccaagaggctgatgaacacgtcaccgtacacgtgtcatgatcttgaagggtttgcaaagggaacgcatatgctgagctggcaaccctagatctgcgctggacattttaaatatctgacttaaataatgattggtacacgtagtcataatcgccaccgttcatcttgagatctctacgtagacttgacgtgctgctgattttattccttttaaataatgaaaatacagaattaaactataatgtataattcatttgagatccacagatgacgaaacgtggactaccaaatcaagcatatttgtttttaccatttaatcgacggctaatattgatttcatctacggtaaaatatatctttttttaaccagaaaaaggttagagtggtccccactgtaggatctactgacttgtgtcggccgttagtggttttataaagctgacgtgtcccactgaataaggaataccgttgtggtccctacggacaacgtgggattcgacgccagctcattttttaattttttcttgaaatcttttttaaaattttagacgatgactcaatcttcgccacgtaggatccacccaataaaaaagggttaacaaaatcttatctttaatgctaaattagttgagattaatccatgttgtttaaatccgaaatgatgcatataatcttgtttcttataatcattaagatttagactgaagatctaattccaatttaagagagtcactaaaaaaagaatgaattcaatttcagacaaatccgacaaggtcaaggtgacgtgttcttgatgccaattctagtgggagccacttgacgcgtgcagttagactcccggtccaagacataaatttacgttaataccctcctttattgggttattattgggccgtagttgaattattagacccaacctttttatcctgttcttgattggcacatactttgcaaaaagttaacaaaataacttttattgcaaggcattacaagagaaatgtcaaatttggttgttgcatacatgacatcttattcatatccaatccataaattgatgtgttgttattcaaactggtcttttgatgtattgttagacatatctcatatatattgaacccttggaatcaatataatagattgggctttatttatcttttattgggcttaaagggaattgttggactaaaaaaaccattaaggctataacacactaattacacgtacaatgagagtgagagtcacggacgggatgattacaagaatcatatagcaccaaatatctcatcctcactctcacatacaaacacacattttgttcacacagagatagacacccagctttcttgtacaaagttggcattataagaaagcattgcttatcaatttgttgcaacgaacaggtcactatcagtcaaaataaaatcattatttg

SEQ ID NO: 91 - DNA, 1700 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctaagtcatacaacatcagtttttgttttgtattcagattttaagacgttcctctattgtctatttgtcttgatctgtcttgcaatggcatattctgctggaggaaacctatgtcaaggaaagatacacaaaatttgccggatgaaatagtgttaacaatatttttcttagagcatactcattgctgaactatttttttgaatgtttcaaaaccaaaatattaaatattttaatatcaaaaacaaactaactattaaaaagaagacatacggagaaaagagtctttaaacaaacgttacaaggtcttaaatgtctctaggaagacacatatctcatatcgattctttaaattcttttatttttatgaccaatggggatggtcttaggaatataatatcgcaatgttgaccaataaccaataatattaatgtaatttcgcaatatagtctattatttttatttttatcttatattttattttatttttttggtcaaatttagtctcctatcttatgtcatgcaaataatggagatgatgatgtaagataagaaagaaaattcaagtttttgctgaatttattagtatttttgaaaaaataaataaactaagaataaatgtttggtggattcaactaattgtatatttattccaatgttcaaaaaatcgttaggcggtaactaggtgttcgatagagacttagcacccagagcgagtaatcggagtctaggcgatagcacattatttcttacttttaaatatttttttacaattttctatcaaaacattggttataaaatatgaaattttaaaaatgttatctatttaaaacttattatattttcacacttttatatataaaaataaaataatttagtcttaaaactaaaaaagttgagaataattaattcataatttagaattttagtacttaaatattttgtttatcttactttgatttaagtatttcacttattcaagatgatgttatatcgaaaagaaaaaaaaaaacaaatcaggcactaaatcggtcaatttgactgatttaaccgattaatactaattttgaacgcctaaaccagtaaaccaatgtttatttaccatctaaataaattttttaaacattgatttattatgtgagagagaaaaaaaacaaactgatagaaccttttttttttttgaacaaacttgtagtcttgtagaactcaatatcaagtattaaatggccataatttcgctcttaaatttgaatgaaggaaagaaacttcctacttggtgaaaaaaaaacaaaaggaaagaaataccccactaaaacgagtaacgacatcttaatggggtcgttatttttgtctacgcggcatcaaatcgagtggacaataagaactaaaccgaagcaacgactttgaatagtcaagcgaaaaggagccaaattctctaataaataagtgaagattcatcgccaagtatcatcagcaaacctaaagctaaaagtgcctctgcatcaacccagctttcttgtacaaagttggcattataagaaagcattgcttatcaatttgttgcaacgaacaggtcactatcagtcaaaataaaatcattatttg

SEQ ID NO: 92 - DNA, 1052 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctaagtgtagattattacaagtatatatatatgactactatattttggttatatgcttatacattttggatatatgttcgggtactcattcggttcgagtttggttatggttctcgggtcttgaggttttgatcccgttcatgtatttttgccagttcgagttggggttggttctgtttactttttctagtccatgtattttgcagacctattaaaaccattctgttttttttttggaccaacaaaacccatccgtttttagatacgaaaataaaattttattaaaaccattatttttcttggaccatcaaaacccatccgtttaaagatacgaaatgaaattcgattgataaatacaaaataaagttcaccaaacttaaataaaaaggcatagatgggaccaatgagaaagaaatttcttttctcctcaatttccccaaaaatatataaaccttaagtttacttttttgttgcaaggaaaaacattaatctttttcaactttctaaaaacaatcatttcaaacgttaaaggaacctcctcctttctttacgcgtttgcaatataacccaagaagaccgcttgtttgtacaactttccaaaaaccaaacagtagtgtaataaacctctgacttcttttttcttctctatttttgtgggtgataatcaattcactcggtttgaaatttcgtccacttttcaaagatgagtgaatgaaaaagccacgaaactttccatttcttcctctgtgtataactctcactgagtacgacttgccattttctcatccaaaaaaaatgtttatccaaatacatatttgtgaactttgcttttaaaccactcaagattcttccccacccagctttcttgtacaaagttggcattataagaaagcattgcttatcaatttgttgcaacgaacaggtcactatcagtcaaaataaaatcattatttg

SEQ ID NO: 93 - DNA, 1700 bp, Artificial Sequence
  Synthetic oligonucleotide sequence
caaataatgattttattttgactgatagtgacctgttcgttgcaacaaattgataagcaatgcttttttataatgccaactttgtacaaaaaagcaggctatttcaatcatttatagctgaaggtgtaccatatagatagatagggacaccagcaatttttacatataaaaaagaaaaaaatatcaaacgatttacaatgtatcatgtcgcgattgggtcttgctgcctcaagaatagggctgatatctcgttttgtccaatcaaagaaaaaacacgtcatattcttattttgatgatttatatattagcattatccaaagtccaaagattataaactgagattcatcttctcgcccttgcacattgtagcaacgtgtgaggcatgtgcgatgcctatacctacaattcacatgtgatccggtatattaaaatatacatgatttatggatacactcgaatacttctccgatattcatttcgcggaaagttgcatatgatccactatctcctatatatttgttatataacacatggcaaatctctctatatatattttttaaatacacatatatccaaaataggcttaactataacacaaagacttttgtttactgtatattagtaagaagtaaatgtattttttaatattatgataaagtttgtgaaatcaccatttgcaatagccatatagggtcgtgttttaattttacagtttgtattgttataattcgattccaaggttgagaatatgtgtgtactattagactatacaaataataattcgttgacgatattgaatatttactaattataggaagagaaaattatttactaactatagtacgatatatttcttctatatgtgtttttaacgtttttttttttttaaatttaagtcttaactttacttctcatttttaatcaaaaggaaaaaaataccaatcaatttttcctaacacagtttacttatcattttcatttgaaatgtgttcactttctgataaaatgctaatcctacaatcaaatacaccattgtcgtgataacacgtgtacggctctaaagcaatcagaacaatcattggacagtttttacaccgtcagataagtacctatccacttgctgactcagccggataaaccctaaaccggaagtttgccccaccgtcaaaattggaagaaaccggacaaaagagaatgtaaagactaagaagtaagaacccatcggacgtcgtaagaaggttaattaacacgtggaaacagctggtcagagttatccggtaacttatccggttacaagtaaaaaaataatttgttcccatacacgactccttcagaaccaaacgcgacatcacggcgccgtttagtgtctataaatagagcaatcggtcgtagaaaaccaagacatcaaaaacacgaatatcgatagtacacttctacgtgcaattttctcctttctcttcctggacatctgtctgtttattacattttcttgtaatctctttttggggttttacaatatctatcccctaaagtttcggaaaattctgtttttctgttctcattcttcgtgatctttttcactttcttcaaaaaaaaaacacccagctttcttgtacaaagttggcattataagaaagcattgcttatcaatttgttgcaacgaacaggtcactatcagtcaaaataaaatcattatttg

SEQ ID NO: 94 - DNA, 630 bp, Artificial Sequence
  Synthetic oligonucleotide sequence
caaataatgattttattttgactgatagtgacctgttcgttgcaacaaattgatgagcaatgcttttttataatgccaactttgtataataaagttgtattcttctgtgcaatagcaacaatggaagattgggttcggtttcagttgttgccataccgtataaatgtgttcttaaagagagtctttttgtcgaggcttttcttcagttgggatgtatatgttttattaaggtgatgagtagtgatttggtgtgtcttttcaaatgctttgtggagtctgtttttccttataaaaatttattctaaatctggtttgtattttgggggtcttctttgctctttcttcattaacagaatactaattataagcttttcatatacaaaccttgaaaggaattttcatcagttactaattcgatttcagagaaatgaatcattcaaaacacttgattagagaaatgcttcttgaaccgggtcggtttaacgaaatccactggctggaaaaattatgcttttatatatataagaagcacccagctttcttgtacaaagttggcattataagaaagcattgcttatcaatttgttgcaacgaacaggtcactatcagtcaaaataaaatcattatttg

SEQ ID NO: 95 - DNA, 1073 bp, Artificial Sequence
  Synthetic oligonucleotide sequence
caaataatgattttattttgactgatagtgacctgttcgttgcaacaaattgatgagcaatgcttttttataatgccaactttgtataataaagttgtactctttgtgctgatgttaaaccggtgtaatacaatgaaaactcaaaggtccggtttaatcaggaaaatatcttctgcacacattgaagtagattgatgctaatgtgtatcaaaaggtccaaagccgcattattgttgcaaaatgcggattgcaaagaagataatagtggtttgtgtccttaggtttagagctaaaaaaggtgtgaaaatgagacttgtgagcgaatcaattattgatcaatggttacgagagatgtcacgctcaactgtcgttatgtctttgacagttgcaatttgcccataaaactttcttgctagaggttatccgcaaacaaaccactaattcaacctcttagctacaatatcttcatgtacgtttttgtcgaaatctcaaaatccatctcctacaatatcatgtttactaattacactttgatggatagccacaaaattttggaaagaagagaatcaattatataacaaaagaatttgcacataagccataataacaaaaataagaaaaaaggaaaagaaaagaatacacagacagaacgaaagcagtatctcctgaatattcaccttttaggattgaaagcatcaaaaagaaaaagaaggaagatcttgacataaaagaaagaaaaaaacaccttaaaagattaaaaacattaccatcaaacataggaatatataaaagcacagcaacctttagaaccaaatccacatgattctgtccactctttttacccatctcttctcatataagttttggctgaagatatatataaatattatacggtttctttctctcttgtcctccttacttaatgcaagagatatgatgagtcttgagagtaatgatcgtaccgcagagtttcacccagctttcttgtacaaagttggcattataagaaagcattgcttatcaatttgttgcaacgaacaggtcactatcagtcaaaataaaatcattatttg

SEQ ID NO: 96 - DNA, 445 bp, Artificial Sequence
  Synthetic oligonucleotide sequence
caaataatgattttattttgactgatagtgacctgttcgttgcaacaaattgatgagcaatgcttttttataatgccaactttgtataataaagttgtagattcatagatcatatatatgtacatcatatccctctttagagcaggtactcgtgttcacctgcaaatgtaacaaagaacattatactatacaacaaatatacacattgaattatacctgtataaccaacataggtcaagattacatcatacgtgggctaggcccattttatattggcccaataagtgagtgactaaatcctttcgttcccaaatatatctccaccgatcaagagattcatcttccacccagctttcttgtacaaagttggcattataagaaagcattgcttatcaatttgttgcaacgaacaggtcactatcagtcaaaataaaatcattatttg

SEQ ID NO: 97 - DNA, 700 bp, Artificial Sequence
  Synthetic oligonucleotide sequence
caaataatgattttattttgactgatagtgacctgttcgttgcaacaaattgatgagcaatgcttttttataatgccaactttgtataataaagttgtaaggttgaagaataagaattaaaaaattgtatttaaactataaaatatgcatacataataaattttgatcgtttttaactaataaaacatatggtgtatcatttcaatctcacatgaattaaatcttggtgtgtatagactatacagtatagtagtttgttttgtaaaccgaaatcagaacactggctgctggccggtttacttaatttatgaatctatatatacatttttgcagtcattttgtgaaataaatcctgtagttgggacttatttacaatggctgccactggattttaatgtttgtttttgataattagaaaaaaaatcttcgaattaaatattttacatttaacaatcttccctaaatctctccacattaactacacggttagttactaaaattaaacttccaaaatatttaatatcatttaattactacaaaattatcatttttgatattgtttttctccatgactataacaattcgactataatcatcaacacccagctttcttgtacaaagttggcattataagaaagcattgcttatcaatttgttgcaacgaacaggtcactatcagtcaaaataaaatcattatttg

SEQ ID NO: 98 - DNA, 374 bp, Artificial Sequence
  Synthetic oligonucleotide sequence
caaataatgattttattttgactgatagtgacctgttcgttgcaacaaattgatgagcaatgcttttttataatgccaactttgtataataaagttgtaaaccgaatatctcttcgaatcacattcatatatatagagtcttgagagtatacacacttgaaaccgtttgtacatacatatacataccattgtgctatgttactcccaggttttgataccttagttttttttacctgcaaatcgatcaaaacccgattttctttgcggagttaccacccagctttcttgtacaaagttggcattataagaaagcattgcttatcaatttgttgcaacgaacaggtcactatcagtcaaaataaaatcattatttg

SEQ ID NO: 99 - DNA, 700 bp, Artificial Sequence
  Synthetic oligonucleotide sequence
caaataatgattttattttgactgatagtgacctgttcgttgcaacaaattgatgagcaatgcttttttataatgccaactttgtataataaagttgtaaattgggctaatgattaacatgaatatttttcataagtctaaaaatatgttattctctctctttcaaaatacattgaatttggtattagttacttttatttatttaagtttggtgttaactttagtactttaagccagaattttctttgaaaatctaaacgaccttattttgagaattctttaagaaagtaagtcttgaaacaattcgaacaagcttaagcttagtttcagcttcttattcttccttagtaatttctcttgatcccgtggcaagtagatttattcctttattgtacgtattgatgatgcctcgatcacttagatgagtccttgttaaagggaaccaaacttcaaatccgactatcattttcttattttctggacaaaaagtctaaactcatatattacagatgtttaaaattttgaatagttttgtctttaacgaggagctacactagtaatggaagcttcgtcgattgaaaagaggtcagatgtatccacacccagctttcttgtacaaagttggcattataagaaagcattgcttatcaatttgttgcaacgaacaggtcactatcagtcaaaataaaatcattatttg

SEQ ID NO: 100 - DNA, 700 bp, Artificial Sequence
  Synthetic oligonucleotide sequence
caaataatgattttattttgactgatagtgacctgttcgttgcaacaaattgatgagcaatgcttttttataatgccaactttgtataataaagttgtatccatatcccctccacttcgccacgtgcttcttcttctctatgtctctatcttgttcactttatgacctctaatcagttgaaatcatatgttgtttacttggaacaattcaatgaaattcagcattttagaaagacagggtattgactttgaaattgaatcatctggtttgactgatagtcaatttaaatggtattaacttttgactaagcacagttagttttcaacatttttaaaattgaacaattaaattgaaaaaacctataagctatggttaaagattgattagtaaaaaatgtttgcttttgcataagagtagaaaaagttttatgggtttaatattttttgtatcaaacatttgaaatatttcttgtatatctgtaaaattattttaaaatatctattataagatttatatgagttttccacttccacatgattcatgtgatacagaaagtgcatctcaaaacttctagagtttccctaccaaaaaaaaaaaaccacccagctttcttgtacaaagttggcattataagaaagcattgcttatcaatttgttgcaacgaacaggtcactatcagtcaaaataaaatcattatttg

SEQ ID NO: 101 - DNA, 700 bp, Artificial Sequence
  Synthetic oligonucleotide sequence
caaataatgattttattttgactgatagtgacctgttcgttgcaacaaattgatgagcaatgcttttttataatgccaactttgtataataaagttgtatactttgagtttgagttactctgtgttcgaattttaaagtatatgtggttttctgttttagtttcgtgtctcaactctcaagtgtagaggaatgttataaactactatgcaatgaaggaactaatacttatgatggtattttactaattatgttattattcataattccatgcattagagccaattgtcgcattttttttctttcagaattcttcaaacttgtcaaatcgaaatctcttctttagaagcgactagattagtttttttcttcaaaagaaattctctactgaatttataatttaaagagttcacgagctgcctactaaaatatgaaaaatatttatgaatccagcaatacaaattgtagctttgcaatacaagaaagaacaacttttcatagagatcaaaaacgctagataaaaaaaaaacggggaagactaactagtaagtaccacgagtataacacattttttggatttagtttctatgattgctttcgccacccagctttcttgtacaaagttggcattataagaaagcattgcttatcaatttgttgcaacgaacaggtcactatcagtcaaaataaaatcattatttg

SEQ ID NO: 102 - DNA, 684 bp, Artificial Sequence
  Synthetic oligonucleotide sequence
caaataatgattttattttgactgatagtgacctgttcgttgcaacaaattgatgagcaatgcttttttataatgccaactttgtataataaagttgtatttgttatgtaacttattcttctaataaaaaactccgctagttcatatcttgttaagtatttggttagcctaagaaattatatagcttgaggtttcacattttcaatattttttaaaaataatttgggtcaatattgatgttggaaatgaaatcaacggttgaattattgtcgtgtgctgcttgcaccatggtccatgctagatggaccgaccactatttttccaaacagtgcctatcctatcaagtagatattttctgaatacgtagataattgtagaatacaagaaaagaaatatcctctgtggaataaatgaataatatacttttgtcagaaacgttacaagttaaaattccacgactgattgccacgtgtaagcttatctcaaaagggccctacagtaccatgatgacgtcatctcttacaccactctctgaaaaattcctccgccttataaaaaaactcgattatcgtcttcacttagtcacccagctttcttgtacaaagttggcattataagaaagcattgcttatcaatttgttgcaacgaacaggtcactatcagtcaaaataaaatcattatttg

SEQ ID NO: 103 - DNA, 700 bp, Artificial Sequence
  Synthetic oligonucleotide sequence
caaataatgattttattttgactgatagtgacctgttcgttgcaacaaattgatgagcaatgcttttttataatgccaactttgtataataaagttgtattaacactaatttttgttttattatggcaataattaattgcataaaagttatgtaaagtgagtttaattaggattagagagatcttttaaagtttttctctcttttctccttgttgtaatccagtgtatttaatcaaatctcagatggagttcaaatttcgagatcatgtttgtttgttttccaacaaatctaatttacaagaagagtagattattgattagtgcttataactcttttgcagtcaagtttctggatcatagacttattatataagttatcgtacaaacatacctttatatatgtacttacagtactattagtagccaactatcttaacccaaattttagctacctaaaatatctaaaaggcaacaaatgaagtaagatccatagtcgattgatctaaaggcaacaattttctggatgcctactcgatggatctaaaaggtaacaatgttcacattttcaagattacttacacttatgataatgagattagcacccagctttcttgtacaaagttggcattataagaaagcattgcttatcaatttgttgcaacgaacaggtcactatcagtcaaaataaaatcattatttg

SEQ ID NO: 104 - DNA, 700 bp, Artificial Sequence
  Synthetic oligonucleotide sequence
caaataatgattttattttgactgatagtgacctgttcgttgcaacaaattgatgagcaatgcttttttataatgccaactttgtataataaagttgtactttgtataagatcattagttgttaattttttaaatatgaatttctaaactatccaccaactaagcatgttgtgacaagcaaaagtatatagataattagatattatatgtatatgtttaaaattgcgtaatatgctttacaggtcgattgttctcctaatcatttgattcttcttaatttattggattacgaaatgacatttctttgtcacctttttcgtgcatatcagatttgtttaaagtttacgtgacgaatgacgattgatcttttatcttgttgtgccgccgtattttgtatggacattacttgtaatactatatatatcagctatgcgttaactatactcatcaaataccacatatgatttattatatcaaagtacttattaataaataattaaattaaccttatattcaattgcacttgggtgagaaagccgttagaaaaaactcccgctatagaagaaatgtggtagatttgaaccgaaattaaatattttcacccagctttcttgtacaaagttggcattataagaaagcattgcttatcaatttgttgcaacgaacaggtcactatcagtcaaaataaaatcattatttg

SEQ ID NO: 105 - DNA, 700 bp, Artificial Sequence
  Synthetic oligonucleotide sequence
caaataatgattttattttgactgatagtgacctgttcgttgcaacaaattgatgagcaatgcttttttataatgccaactttgtataataaagttgtatatgacgtgattatggtgaaatttttaataaattcgtgtggcaatcaattaaagagagaataacaatatattaattggagcaaatcgcctttcttataaagtttcctcttaccaagtgtgtgtgagttgagtaaataagaaaacccttttataagcccgcaaaacccatacaaacaggaatgaaccgccaatgtccctaagaatatggactcctagcagctaaacgtgcctagtcaagccccgtggagccgcgtaggcagagagggggagataaaagagaagaggagagtgttgcatggaattacattttagttgatttttggaaggatttggtccaccctgtcttcatcaagtcacatacaccaccagttatcattttgtattcataattttaagaaattgatcttttgtcttgatctgtcttgcaatgacatatcctactggagacttgtatcaggaaaattcaaaattgccggagaaaatagtgttaagctttttttcacccagctttcttgtacaaagttggcattataagaaagcattgcttatcaatttgttgcaacgaacaggtcactatcagtcaaaataaaatcattatttg

SEQ ID NO: 106 - DNA, 462 bp, Artificial Sequence
  Synthetic oligonucleotide sequence
caaataatgattttattttgactgatagtgacctgttcgttgcaacaaattgatgagcaatgcttttttataatgccaactttgtataataaagttgtaaaagaaaaagaaaaatgaatcatcagtctcttttgatcgcttcatgaggttttttattgtatacgaaaccttcagaaaaaatacatgtatccatgcttgttgttgacgtcaaagttcagttcatcaaaaagatcttatctaatgagaaatgctttttatagaagtgtaccttaaaaccttgaattaaaaaaaacattgtattgtgttaagcacaaaaactgtggagggatacataatttgaagagcctctgatagtattaaccacccagctttcttgtacaaagttggcattataagaaagcattgcttatcaatttgttgcaacgaacaggtcactatcagtcaaaataaaatcattatttg

SEQ ID NO: 107 - DNA, 700 bp, Artificial Sequence
  Synthetic oligonucleotide sequence
caaataatgattttattttgactgatagtgacctgttcgttgcaacaaattgatgagcaatgcttttttataatgccaactttgtataataaagttgtacttcgaaggagaaatggatgaaatatgtgttatatcttcccaatgggtgaagtgttttgtatgattttaaaaataagaatgtgatcctttttttttcctatgaagatctgaatgtataatctatcttgtaaaaatttgtttctttgtaagatttgaatgtaccgcttttacgtagatcgatgtacatcaatcttataagtttcaattatgtattatattatgtcgatttgccaaaaataaatctaaaacctcaaaaataaatctggttttagatacttgtatatagtactaactcgatgaaaaaatgattttttttttgttactgaatctgaaatataattataaaataaaaatactaattattaataaatcaatttaccaaaaattttaaattttgataacaaaaaattaaatctagtcaatttttaaaagttcttttttgatatttcaaatatccgaattcgaaataattccaaccgaattcatagtcgactcaaacacacccagctttcttgtacaaagttggcattataagaaagcattgcttatcaatttgttgcaacgaacaggtcactatcagtcaaaataaaatcattatttg

SEQ ID NO: 108 - DNA, 331 bp, Artificial Sequence
  Synthetic oligonucleotide sequence
gattcatagtgactggatatgttgtgttttacagtattatgtagtctgttttttatgcaaaatctaatttaatatattgatatttatatcattttacgtttctcgttcaacttttctatacaaagttgtaatggactacaaagaccatgacggtgattataaagatcatgacatcgattacaaggatgacgatgacaagtgaacaactttgtataataaagttgaacgagaaacgtaaaatgatataaatatcaatatattaaattagattttgcataaaaaacagactacataatactgtaaaacacaacatatccagtcactatgaatc

SEQ ID NO: 109 - DNA, 310 bp, Artificial Sequence
  Synthetic oligonucleotide sequence
gattcatagtgactggatatgttgtgttttacagtattatgtagtctgttttttatgcaaaatctaatttaatatattgatatttatatcattttacgtttctcgttcaacttttctatacaaagttgtaatggaaggaaagcctattcctaatcctcttcttggacttgattctacttgaacaactttgtataataaagttgaacgagaaacgtaaaatgatataaatatcaatatattaaattagattttgcataaaaaacagactacataatactgtaaaacacaacatatccagtcactatgaatc

SEQ ID NO: 110 - DNA, 385 bp, Artificial Sequence
  Synthetic oligonucleotide sequence
gattcatagtgactggatatgttgtgttttacagtattatgtagtctgttttttatgcaaaatctaatttaatatattgatatttatatcattttacgtttctcgttcaacttttctatacaaagttgtaatgggacttattaacatcttttacccatacgatgttcctgattatgctggatacccatacgatgttcctgattatgctggatcttacccatacgatgttcctgattatgctgctcagtgctcttagacaactttgtataataaagttgaacgagaaacgtaaaatgatataaatatcaatatattaaattagattttgcataaaaaacagactacataatactgtaaaacacaacatatccagtcactatgaatc

SEQ ID NO: 111 - DNA, 424 bp, Artificial Sequence
  Synthetic oligonucleotide sequence
gattcatagtgactggatatgttgtgttttacagtattatgtagtctgttttttatgcaaaatctaatttaatatattgatatttatatcattttacgtttctcgttcaacttttctatacaaagttgtaatggaacaaaagcttatttctgaggaagatcttaacggtgaacaaaagcttatttctgaggaagatcttaacggacttgatggagaacaaaagcttatttctgaggaagatcttaacggagaacaaaagcttatttctgaggaagatcttaacggttctgcttagacaactttgtataataaagttgaacgagaaacgtaaaatgatataaatatcaatatattaaattagattttgcataaaaaacagactacataatactgtaaaacacaacatatccagtcactatgaatc

SEQ ID NO: 112 - DNA, 283 bp, Artificial Sequence
  Synthetic oligonucleotide sequence
gattcatagtgactggatatgttgtgttttacagtattatgtagtctgttttttatgcaaaatctaatttaatatattgatatttatatcattttacgtttctcgttcaacttttctatacaaagttgtaatggatacttatagatatatttgaacaactttgtataataaagttgaacgagaaacgtaaaatgatataaatatcaatatattaaattagattttgcataaaaaacagactacataatactgtaaaacacaacatatccagtcactatgaatc

SEQ ID NO: 113 - DNA, 292 bp, Artificial Sequence
  Synthetic oligonucleotide sequence
gattcatagtgactggatatgttgtgttttacagtattatgtagtctgttttttatgcaaaatctaatttaatatattgatatttatatcattttacgtttctcgttcaacttttctatacaaagttgtaatgtcttggaaagatgcttctggatggtcttgaacaactttgtataataaagttgaacgagaaacgtaaaatgatataaatatcaatatattaaattagattttgcataaaaaacagactacataatactgtaaaacacaacatatccagtcactatgaatc

SEQ ID NO: 114 - DNA, 391 bp, Artificial Sequence
  Synthetic oligonucleotide sequence
gattcatagtgactggatatgttgtgttttacagtattatgtagtctgttttttatgcaaaatctaatttaatatattgatatttatatcattttacgtttctcgttcaacttttctatacaaagttgtaatggctggatctactggagcttcttggtctcatcctcaatttgaaaagggaggaggttctggaggtggatctggtggaggatcatggtctcatccacagttcgaaaagggagctggatctaggcctatttgaacaactttgtataataaagttgaacgagaaacgtaaaatgatataaatatcaatatattaaattagattttgcataaaaaacagactacataatactgtaaaacacaacatatccagtcactatgaatc

SEQ ID NO: 115 - DNA, 289 bp, Artificial Sequence
  Synthetic oligonucleotide sequence
gattcatagtgactggatatgttgtgttttacagtattatgtagtctgttttttatgcaaaatctaatttaatatattgatatttatatcattttacgtttctcgttcaacttttctatacaaagttgtaatgtctcatcatcatcatcatcatgcttagacaactttgtataataaagttgaacgagaaacgtaaaatgatataaatatcaatatattaaattagattttgcataaaaaacagactacataatactgtaaaacacaacatatccagtcactatgaatc

SEQ ID NO: 116 - DNA, 298 bp, Artificial Sequence
  Synthetic oligonucleotide sequence
gattcatagtgactggatatgttgtgttttacagtattatgtagtctgttttttatgcaaaatctaatttaatatattgatatttatatcattttacgtttctcgttcaacttttctatacaaagttgtaatggcttctatgactggtggacagcaaatgggtgcttagacaactttgtataataaagttgaacgagaaacgtaaaatgatataaatatcaatatattaaattagattttgcataaaaaacagactacataatactgtaaaacacaacatatccagtcactatgaatc

SEQ ID NO: 117 - DNA, 80 bp, Artificial Sequence
  Synthesized DNA sequence upstream of position binding vector
aagcttattaccctgttatccctaaccggtagataagttgatttagccataaaatattgtttccgtgacccccctgcagg

SEQ ID NO: 118 - DNA, 80 bp, Artificial Sequence
  Synthesized DNA sequence upstream of position binding vector
aagcttattaccctgttatccctaaccggttctgagtcacggcttcattggcattccgtacaacgaacgtcccctgcagg

SEQ ID NO: 119 - DNA, 80 bp, Artificial Sequence
  Synthesized DNA sequence upstream of position binding vector
aagcttattaccctgttatccctaaccggtcctcagagagcctatagcggtaaaacaacaccatgcatcccccctgcagg

SEQ ID NO: 120 - DNA, 80 bp, Artificial Sequence
  Synthesized DNA sequence upstream of position binding vector
aagcttattaccctgttatccctaaccggtcgcagtcgcttcctgtaaatagagcattaaattccatagtcccctgcagg

SEQ ID NO: 121 - DNA, 80 bp, Artificial Sequence
  Synthesized DNA sequence upstream of position binding vector
aagcttattaccctgttatccctaaccggtacttaatcgaaaaaaaaacagacagccatgtgctcttcggcccctgcagg

SEQ ID NO: 122 - DNA, 80 bp, Artificial Sequence
  Synthesized DNA sequence upstream of position binding vector
aagcttattaccctgttatccctaaccggtggacatgattatggaacacacacacgctagccgcccagttcccctgcagg

SEQ ID NO: 123 - DNA, 83 bp, Artificial Sequence
  Synthesized DNA sequence down stream of position binding vector
ggtaccggtgcgtttttatgcttgtagtattgtataatgtttttaagatccttaattaatagggataacagggtaatactagt

SEQ ID NO: 124 - DNA, 83 bp, Artificial Sequence
  Synthesized DNA sequence down stream of position binding vector
ggtaccggtctaatacccaatctctcgtcttatccagatgttttatacgccttaattaatagggataacagggtaatactagt

SEQ ID NO: 125 - DNA, 83 bp, Artificial Sequence
  Synthesized DNA sequence down stream of position binding vector
ggtaccggtgaattcccttatgtgagtgtaaaaggcaggcgagtttgtcccttaattaatagggataacagggtaatactagt

SEQ ID NO: 126 - DNA, 83 bp, Artificial Sequence
  Synthesized DNA sequence down stream of position binding vector
ggtaccggttgcttgcaaaagcagtaattggaaagcactctcaaagaatccttaattaatagggataacagggtaatactagt

SEQ ID NO: 127 - DNA, 83 bp, Artificial Sequence
  Synthesized DNA sequence down stream of position binding vector
ggtaccggtagataagttgatttagccataaaatattgtttccgtgaccccttaattaatagggataacagggtaatactagt

SEQ ID NO: 128 - DNA, 83 bp, Artificial Sequence
  Synthesized DNA sequence down stream of position binding vector
ggtaccggttctgagtcacggcttcattggcattccgtacaacgaacgtccttaattaatagggataacagggtaatactagt

SEQ ID NO: 129 - DNA, 83 bp, Artificial Sequence
  Synthesized DNA sequence down stream of position binding vector
ggtaccggtcctcagagagcctatagcggtaaaacaacaccatgcatccccttaattaatagggataacagggtaatactagt

SEQ ID NO: 130 - DNA, 83 bp, Artificial Sequence
  Synthesized DNA sequence down stream of position binding vector
ggtaccggtcgcagtcgcttcctgtaaatagagcattaaattccatagtccttaattaatagggataacagggtaatactagt

SEQ ID NO: 131 - DNA, 83 bp, Artificial Sequence
  Synthesized DNA sequence down stream of position binding vector
ggtaccggtacttaatcgaaaaaaaaacagacagccatgtgctcttcggccttaattaatagggataacagggtaatactagt

SEQ ID NO: 132 - DNA, 83 bp, Artificial Sequence
  Synthesized DNA sequence down stream of position binding vector
ggtaccggtggacatgattatggaacacacacacgctagccgcccagttccttaattaatagggataacagggtaatactagt

SEQ ID NO: 133 - DNA, 83 bp, Artificial Sequence
  Synthesized DNA sequence down stream of position binding vector
ggtaccggtgagcccaaacagcgaaatacctgagcgaacaaatactactccttaattaatagggataacagggtaatactagt

SEQ ID NO: 134 - DNA, 128 bp, Artificial Sequence
  Synthesized DNA sequence up stream of adapter vector
aagcttggtgcgtttttatgcttgtagtattgtataatgtttttaagatccttaattaaggtgcgtttttatgcttgtagtattgtataatgtttttaagatcctagggataacagggtaatgagctc

SEQ ID NO: 135 - DNA, 128 bp, Artificial Sequence
  Synthesized DNA sequence up stream of adapter vector
aagcttggtctaatacccaatctctcgtcttatccagatgttttatacgccttaattaaggtgcgtttttatgcttgtagtattgtataatgtttttaagatcctagggataacagggtaatgagctc

SEQ ID NO: 136 - DNA, 128 bp, Artificial Sequence
  Synthesized DNA sequence up stream of adapter vector
aagcttggtgaattcccttatgtgagtgtaaaaggcaggcgagtttgtcccttaattaaggtgcgtttttatgcttgtagtattgtataatgtttttaagatcctagggataacagggtaatgagctc

SEQ ID NO: 137 - DNA, 128 bp, Artificial Sequence
  Synthesized DNA sequence up stream of adapter vector
aagcttggttgcttgcaaaagcagtaattggaaagcactctcaaagaatccttaattaaggtgcgtttttatgcttgtagtattgtataatgtttttaagatcctagggataacagggtaatgagctc

SEQ ID NO: 138 - DNA, 128 bp, Artificial Sequence
  Synthesized DNA sequence up stream of adapter vector
aagcttggtagataagttgatttagccataaaatattgtttccgtgaccccttaattaaggtgcgtttttatgcttgtagtattgtataatgtttttaagatcctagggataacagggtaatgagctc

SEQ ID NO: 139 - DNA, 128 bp, Artificial Sequence
  Synthesized DNA sequence up stream of adapter vector
aagcttggttctgagtcacggcttcattggcattccgtacaacgaacgtccttaattaaggtgcgtttttatgcttgtagtattgtataatgtttttaagatcctagggataacagggtaatgagctc

SEQ ID NO: 140 - DNA, 128 bp, Artificial Sequence
  Synthesized DNA sequence up stream of adapter vector
aagcttggtcctcagagagcctatagcggtaaaacaacaccatgcatccccttaattaaggtgcgtttttatgcttgtagtattgtataatgtttttaagatcctagggataacagggtaatgagctc

SEQ ID NO: 141 - DNA, 128 bp, Artificial Sequence
  Synthesized DNA sequence up stream of adapter vector
aagcttggtcgcagtcgcttcctgtaaatagagcattaaattccatagtccttaattaaggtgcgtttttatgcttgtagtattgtataatgtttttaagatcctagggataacagggtaatgagctc

SEQ ID NO: 142 - DNA, 128 bp, Artificial Sequence
  Synthesized DNA sequence up stream of adapter vector
aagcttggtacttaatcgaaaaaaaaacagacagccatgtgctcttcggccttaattaaggtgcgtttttatgcttgtagtattgtataatgtttttaagatcctagggataacagggtaatgagctc

SEQ ID NO: 143 - DNA, 128 bp, Artificial Sequence
  Synthesized DNA sequence up stream of adapter vector
aagcttggtggacatgattatggaacacacacacgctagccgcccagttccttaattaaggtgcgtttttatgcttgtagtattgtataatgtttttaagatcctagggataacagggtaatgagctc

SEQ ID NO: 144 - DNA, 128 bp, Artificial Sequence
  Synthesized DNA sequence up stream of adapter vector
aagcttggtgagcccaaacagcgaaatacctgagcgaacaaatactactccttaattaaggtgcgtttttatgcttgtagtattgtataatgtttttaagatcctagggataacagggtaatgagctc

SEQ ID NO: 145 - DNA, 59 bp, Artificial Sequence
  Synthesized DNA sequence down stream of adapter vector
gcggccgcggtgcgtttttatgcttgtagtattgtataatgtttttaagatcctctaga

SEQ ID NO: 146 - DNA, 128 bp, Artificial Sequence
  A synthesized DNA sequences positioned in ?carrier vector
aagctttagggataacagggtaatggtttaccgagctcttattggttttcaaacttcattgactgtgccttaattaaggtatcactagtattacagaggtaagttataacagtcgcctaaccgaattc

SEQ ID NO: 147 - DNA, 23 bp, Artificial Sequence
  Synthetic oligonucleotide primer
atgacaggaggctttaggaaatg

SEQ ID NO: 148 - DNA, 24 bp, Artificial Sequence
  Synthetic oligonucleotide primer
ttatactgcggtagaaggtgagag

SEQ ID NO: 149 - DNA, 24 bp, Artificial Sequence
  Synthetic oligonucleotide primer
atgtcgactgtgaagctagatagg

SEQ ID NO: 150 - DNA, 22 bp, Artificial Sequence
  Synthetic oligonucleotide primer
ctaaccagtgttctgcagacca

SEQ ID NO: 151 - DNA, 24 bp, Artificial Sequence
  Synthetic oligonucleotide primer
atgtgtgagagcttcaagagagaa

SEQ ID NO: 152 - DNA, 20 bp, Artificial Sequence
  Synthetic oligonucleotide primer
ttacatgttggccaatcctc

SEQ ID NO: 153 - DNA, 19 bp, Artificial Sequence
  Synthetic oligonucleotide primer
atggccgttgaacctcttc

SEQ ID NO: 154 - DNA, 22 bp, Artificial Sequence
  Synthetic oligonucleotide primer
ttaagtcaggcatgagtaggcc

SEQ ID NO: 155 - DNA, 20 bp, Artificial Sequence
  Synthetic oligonucleotide primer
atgggtggtagcaatgcatt

SEQ ID NO: 156 - DNA, 20 bp, Artificial Sequence
  Synthetic oligonucleotide primer
tcaacggaaactccggtaag

SEQ ID NO: 157 - DNA, 19 bp, Artificial Sequence
  Synthetic oligonucleotide primer
atggcgtcagctttcaagg

SEQ ID NO: 158 - DNA, 20 bp, Artificial Sequence
  Synthetic oligonucleotide primer
tcaaacgacttgagctgctg

SEQ ID NO: 159 - DNA, 22 bp, Artificial Sequence
  Synthetic oligonucleotide primer
atgttagcttgtgctagcctcg

SEQ ID NO: 160 - DNA, 25 bp, Artificial Sequence
  Synthetic oligonucleotide primer
ctaatagcgcttagatattctgggc

SEQ ID NO: 161 - DNA, 25 bp, Artificial Sequence
  Synthetic oligonucleotide primer
atggcggggaaattcggatcactga

SEQ ID NO: 162 - DNA, 28 bp, Artificial Sequence
  Synthetic oligonucleotide primer
atttctgaactgaagggacaccatcaac

SEQ ID NO: 163 - DNA, 23 bp, Artificial Sequence
  Synthetic oligonucleotide primer
atgaatcataatcacgatcccaa

SEQ ID NO: 164 - DNA, 26 bp, Artificial Sequence
  Synthetic oligonucleotide primer
tcatgtatatcccgaatttgaataca

SEQ ID NO: 165 - DNA, 53 bp, Artificial Sequence
  Synthetic oligonucleotide primer
ggggacaactttgtatacaaaagttgtaatgacaggaggctttaggaaatgca

SEQ ID NO: 166 - DNA, 55 bp, Artificial Sequence
  Synthetic oligonucleotide primer
ggggacaactttgtatagaaaagttgggtttactgcggtagaaggtgagaggcca

SEQ ID NO: 167 - DNA, 53 bp, Artificial Sequence
  Synthetic oligonucleotide primer
ggggacaactttgtatacaaaagttgtaatgtcgactgtgaagctagataggc

SEQ ID NO: 168 - DNA, 55 bp, Artificial Sequence
  Synthetic oligonucleotide primer
ggggacaactttgtatagaaaagttgggttaccagtgttctgcagaccagcagca

SEQ ID NO: 169 - DNA, 53 bp, Artificial Sequence
  Synthetic oligonucleotide primer
ggggacaactttgtatacaaaagttgtaatgtgtgagagcttcaagagagaat

SEQ ID NO: 170 - DNA, 55 bp, Artificial Sequence
  Synthetic oligonucleotide primer
ggggacaactttgtatagaaaagttgggttcatgttggccaatcctccactggtt

SEQ ID NO: 171 - DNA, 53 bp, Artificial Sequence
  Synthetic oligonucleotide primer
ggggacaactttgtatacaaaagttgtaatggccgttgaacctcttcgcgttc

SEQ ID NO: 172 - DNA, 55 bp, Artificial Sequence
  Synthetic oligonucleotide primer
ggggacaactttgtatagaaaagttgggttagtcaggcatgagtaggccaatgtc

SEQ ID NO: 173 - DNA, 53 bp, Artificial Sequence
  Synthetic oligonucleotide primer
ggggacaactttgtatacaaaagttgtaatgggtggtagcaatgcattgaatg

SEQ ID NO: 174 - DNA, 55 bp, Artificial Sequence
  Synthetic oligonucleotide primer
ggggacaactttgtatagaaaagttgggttacggaaactccggtaagtagggttg

SEQ ID NO: 175 - DNA, 53 bp, Artificial Sequence
  Synthetic oligonucleotide primer
ggggacaactttgtatacaaaagttgtaatggcgtcagctttcaaggggatct

SEQ ID NO: 176 - DNA, 55 bp, Artificial Sequence
  Synthetic oligonucleotide primer
ggggacaactttgtatagaaaagttgggttaacgacttgagctgctgccagcctt

SEQ ID NO: 177 - DNA, 53 bp, Artificial Sequence
  Synthetic oligonucleotide primer
ggggacaactttgtatacaaaagttgtaatgttagcttgtgctagcctcggcc

SEQ ID NO: 178 - DNA, 55 bp, Artificial Sequence
  Synthetic oligonucleotide primer
ggggacaactttgtatagaaaagttgggttatagcgcttagatattctgggcatc

SEQ ID NO: 179 - DNA, 53 bp, Artificial Sequence
  Synthetic oligonucleotide primer
ggggacaactttgtatacaaaagttgtaatggcggggaaattcggatcactga

SEQ ID NO: 180 - DNA, 55 bp, Artificial Sequence
  Synthetic oligonucleotide primer
ggggacaactttgtatagaaaagttgggttatttctgaactgaagggacaccatc

SEQ ID NO: 181 - DNA, 53 bp, Artificial Sequence
  Synthetic oligonucleotide primer
ggggacaactttgtatacaaaagttgtaatgaatcataatcacgatcccaaaa

SEQ ID NO: 182 - DNA, 55 bp, Artificial Sequence
  Synthetic oligonucleotide primer
ggggacaactttgtatagaaaagttgggtttgtatatcccgaatttgaatacaaa

SEQ ID NO: 183 - DNA, 56 bp, Artificial Sequence
  Synthetic oligonucleotide primer
ggggacaagtttgtacaaaaaagcaggcttagatttctatcaatgaaagtagacgt

SEQ ID NO: 184 - DNA, 52 bp, Artificial Sequence
  Synthetic oligonucleotide primer
ggggacaacttttgtatacaaagttgtagtgaaagacggatcgaataaattt

SEQ ID NO: 185 - DNA, 56 bp, Artificial Sequence
  Synthetic oligonucleotide primer
ggggacaagtttgtacaaaaaagcaggcttattcattaaaaaaatatttttatact

SEQ ID NO: 186 - DNA, 52 bp, Artificial Sequence
  Synthetic oligonucleotide primer
ggggacaacttttgtatacaaagttgttgttagttcttgtggggaatatttc

SEQ ID NO: 187 - DNA, 56 bp, Artificial Sequence
  Synthetic oligonucleotide primer
ggggacaagtttgtacaaaaaagcaggcttactgaaatttagtagagaaaaatata

SEQ ID NO: 188 - DNA, 52 bp, Artificial Sequence
  Synthetic oligonucleotide primer
ggggacaacttttgtatacaaagttgtattttccccttctctgttttggaag

SEQ ID NO: 189 - DNA, 56 bp, Artificial Sequence
  Synthetic oligonucleotide primer
ggggacaagtttgtacaaaaaagcaggcttactctttctaatttcaggttataatt

SEQ ID NO: 190 - DNA, 52 bp, Artificial Sequence
  Synthetic oligonucleotide primer
ggggacaacttttgtatacaaagttgtcgccgatcttcagtaaattaacaat

SEQ ID NO: 191 - DNA, 56 bp, Artificial Sequence
  Synthetic oligonucleotide primer
ggggacaagtttgtacaaaaaagcaggcttattttaaatatctgtattttgcctcc

SEQ ID NO: 192 - DNA, 52 bp, Artificial Sequence
  Synthetic oligonucleotide primer
ggggacaacttttgtatacaaagttgtagaaatattggatgaagaaaaattg

SEQ ID NO: 193 - DNA, 56 bp, Artificial Sequence
  Synthetic oligonucleotide primer
ggggacaagtttgtacaaaaaagcaggcttagaacagataagtgaagtttctctgc

SEQ ID NO: 194 - DNA, 52 bp, Artificial Sequence
  Synthetic oligonucleotide primer
ggggacaacttttgtatacaaagttgtcgagtttgattttcttgtttaaaac

SEQ ID NO: 195 - DNA, 56 bp, Artificial Sequence
  Synthetic oligonucleotide primer
ggggacaagtttgtacaaaaaagcaggcttattaataaattagtaatgaacaccta

SEQ ID NO: 196 - DNA, 52 bp, Artificial Sequence
  Synthetic oligonucleotide primer
ggggacaacttttgtatacaaagttgtgattctttaggtactcttcttcaat

SEQ ID NO: 197 - DNA, 56 bp, Artificial Sequence
  Synthetic oligonucleotide primer
ggggacaagtttgtacaaaaaagcaggcttaaccgcttaatatcgtatgattagta

SEQ ID NO: 198 - DNA, 52 bp, Artificial Sequence
  Synthetic oligonucleotide primer
ggggacaacttttgtatacaaagttgtttcgttcttcgttgcgtttttggtc

SEQ ID NO: 199 - DNA, 56 bp, Artificial Sequence
  Synthetic oligonucleotide primer
ggggacaagtttgtacaaaaaagcaggcttaagcttatagcgtagagatgattcac

SEQ ID NO: 200 - DNA, 52 bp, Artificial Sequence
  Synthetic oligonucleotide primer
ggggacaacttttgtatacaaagttgtggtggactcttgttttgggacttga

SEQ ID NO: 201 - DNA, 56 bp, Artificial Sequence
  Synthetic oligonucleotide primer
ggggacaagtttgtacaaaaaagcaggcttaagtaaagagaatgattattgagaat

SEQ ID NO: 202 - DNA, 52 bp, Artificial Sequence
  Synthetic oligonucleotide primer
ggggacaacttttgtatacaaagttgttgctttttgagctttggagactttt

SEQ ID NO: 203 - DNA, 56 bp, Artificial Sequence
  Synthetic oligonucleotide primer
ggggacaagtttgtacaaaaaagcaggcttaaaagaagagagaggaaggagaagag

SEQ ID NO: 204 - DNA, 52 bp, Artificial Sequence
  Synthetic oligonucleotide primer
ggggacaacttttgtatacaaagttgtgtctatctctgtgtgaacaaaatgt

SEQ ID NO: 205 - DNA, 56 bp, Artificial Sequence
  Synthetic oligonucleotide primer
ggggacaagtttgtacaaaaaagcaggcttaaagtcatacaacatcagtttttgtt

SEQ ID NO: 206 - DNA, 52 bp, Artificial Sequence
  Synthetic oligonucleotide primer
ggggacaacttttgtatacaaagttgttgatgcagaggcacttttagcttta

SEQ ID NO: 207 - DNA, 56 bp, Artificial Sequence
  Synthetic oligonucleotide primer
ggggacaagtttgtacaaaaaagcaggcttaaagtgtagattattacaagtatata

SEQ ID NO: 208 - DNA, 52 bp, Artificial Sequence
  Synthetic oligonucleotide primer
ggggacaacttttgtatacaaagttgtggggaagaatcttgagtggtttaaa

SEQ ID NO: 209 - DNA, 56 bp, Artificial Sequence
  Synthetic oligonucleotide primer
ggggacaagtttgtacaaaaaagcaggcttaatttcaatcatttatagctgaaggt

SEQ ID NO: 210 - DNA, 52 bp, Artificial Sequence
  Synthetic oligonucleotide primer
ggggacaacttttgtatacaaagttgtgttttttttttgaagaaagtgaaaa

SEQ ID NO: 211 - protein, 6 aa, Artificial sequence
  Polypeptide linker
ASGGGA

We claim:

1. A method of enhancing Crassulacean acid metabolism (CAM) pathways, comprising increasing expression of at least one gene encoding McALMT4 (*Mesembryanthemum crystallinum* [putative] aluminum-activated malate transporter 4), at least one gene encoding MctDT (*Mesembryanthemum crystallinum* tonoplast dicarboxylate transporter), at least one gene encoding McPpdk-RP (*Mesembryanthemum crystallinum* pyruvate orthophosphate dikinase-regulatory protein), at least one gene encoding McBca2 (*Mesembryanthemum crystallinum* Beta carbonic anhydrase 2), at least one gene encoding McPpck (*Mesembryanthemum crystallinum* phosphoenolpyruvate carboxylase kinase), at least one gene encoding McPpc1 (*Mesembryanthemum crystallinum* phosphoenolpyruvate carboxylase 1), at least one gene encoding McNAD-Mdh2 (*Mesembryanthemum crystallinum* NAD(P) malate dehydrogenase 2), at least one gene encoding McNADP-ME3 (*Mesembryanthemum crystallinum* NADP-dependent malic enzyme 3), and at least one gene encoding McPpdk1 (*Mesembryanthemum crystallinum* pyruvate orthophosphate dikinase 1) in a plant cell as compared to expression in a control plant, thereby enhancing CAM in the plant cell.

2. The method of claim 1, further comprising:
inserting each gene into a vector construct to be operably linked to a plant circadian controlling promoter, thereby generating at least nine vector constructs; and transforming the plant cell with the at least nine generated vector constructs.

3. The method of claim 2, wherein a first vector construct of the nine vector constructs has the nucleic acid sequence as set forth in SEQ ID NO: 60, a second vector construct of the nine vector constructs has the nucleic acid sequence as set forth in SEQ ID NO: 61, a third vector construct of the nine vector constructs has the nucleic acid sequence as set forth in SEQ ID NO: 62, a fourth vector construct of the nine vector constructs has the nucleic acid sequence as set forth in SEQ ID NO: 63, a fifth vector construct of the nine vector constructs has the nucleic acid sequence as set forth in SEQ ID NO: 64, a sixth vector construct of the nine vector constructs has the nucleic acid sequence as set forth in SEQ ID NO: 65, a seventh vector construct of the nine vector constructs has the nucleic acid sequence as set forth in SEQ ID NO: 66, an eighth vector construct of the nine vector constructs has the nucleic acid sequence as set forth in SEQ ID NO: 67, and a ninth vector construct of the nine vector constructs has the nucleic acid sequence as set forth in SEQ ID NO: 68.

4. The method of claim 2, further comprising combining the at least nine generated vector constructs, into a series of complex gene circuits using Gibson isothermal assembly to generate a CAM gene circuit construct.

5. The method of claim 4, wherein the CAM gene circuit construct has the nucleic acid sequence as set forth in SEQ ID NO: 69.

6. The method of claim 1, wherein the method is used to increase plant cell size as compared to the control plant, increase leaf size as compared to the control plant, increase leaf number as compared to the control plant, increase hypocotyl length as compared to the control plant, increase inflorescence width as compared to the control plant, increase inflorescence height as compared to the control plant, increase plant root size as compared to the control plant, increase plant root length as compared to the control plant, increase plant tissue succulence as compared to the control plant, increase plant water content as compared to the control plant, increase plant flower size as compared to the control plant, increase plant floral organ size as compared to the control plant, increase plant silique as compared to the control plant, increase fruit size as compared to the control plant, increase plant seed size as compared to the control plant, increase plant seed area as compared to the control plant, increase plant mass as compared to the control plant, increase plant seed number as compared to the control plant, increase plant total seed production as compared to the control plant, increase plant inflorescence number as compared to the control plant, increase malate content as compared to the control plant, increase net $CO_2$ assimilation as compared to the control plant, decrease stromal conductance as compared to the control plant, [decrease transpiration as compared to the control plant, increase instantaneous and integrated water-use efficiency as compared to the control plant,] increase drought tolerance as compared to the control plant, and protect against or reduce photooxidative damage as compared to the control plant, or any combination thereof.

7. The method of claim 1, wherein the method is used in combination with one or of the following:
(a) engineering tissue succulence to generate a plant with improved drought tolerance and/or water-use efficiency;
(b) engineering tissue succulence to reduce intracellular air space with the resulting plant becoming an anatomically optimized host for performance of CAM;
(c) engineering tissue succulence to increase plant tolerance to salinity and related salts that impose an ionic stress; and/or
(d) engineering tissue succulence to increase plant tolerance to osmotic stress.

* * * * *